United States Patent 11,123,379 (COMPOSITIONS COMPRISING BACTERIAL STRAINS) - sequence listing, part 2

SEQ ID NO: 4 - DNA, 3592167 bp, Roseburia hominis (residues 1,796,085-3,592,167 of 3,592,167)
tttttcgcaatgaagcttgccacaaagagtgaaaccggcgtgattaccacgactgccaccgtgatccgcacgctgatcgtcagcatgaaaatcaacgttccgaagatggtcacaataccggtaaagaactgggtaaatcccatcagaagtccgtctgcgaactgatcaacatccgcgatcacacggcttacgatctctccgtatgaatgagcgtccagatatttcagaggaagcttttcaatcttctcgaacgcctctgtccggatatcccggatcacattgtaggtaattttattgttgcaggcattcatcacccactgtgccactgccgtcagtccgatgatgaccgccatctttctgagaatcacaaagatcccggcaaagtcaacggctccctttcccacgatccggtcgaccgcctgaccgatcagaatcggaagatacagggtaagcgccaccgtcaccgccgcgagaatgatcgatgctcccaggtatccccagtatcgtctgatgtatcgcagaaccttgcgcagcgttgatttttgattttcatttaccacttttttcatcttttcgcctctcccgcctgctgttcttctgtccgcttaaactgcgactcgtaaatctcgcggtatacctcgcagtccttaagcagatcctcgtgtgttccaagtcctacaatctctccatcgtccagcactacgatcttgtccgcctgcatgatggacgccgcacgctgcgatacgataaataccgtcatctgcccgtccatatgtgcgatggctttccgaagcgccgcgtccgtcgcgaaatcaagcgcggatgcgctgtcgtccataatgagaatctgcggcttcttcacgagcgcacgcgcaatcgtaaggcgctgtctctgtccgccagaaaggtttctgccgccctgctcgatctcataggaaagtccgccttccttggcatccacaaactcccttgcctgtgcagtctcaagcgcctcatacatctcctcgtccgtggcgtccgaattgccccagcttaagttctcacggatggttcccttaaagagaaccgccttctgcagaacaacaccgaccttcgccctgagttcctccaatgtataatcccgcacattcttcccgtcgacgagaacctctcctctggtcgcatcgtaaaaccgcggaatcagattcacgaccgaagattttccagaaccggttcctccgataataccgatggtctctccgcgtctgaccgtaaaatcaatgtcggagagcgcttcttccgatgcgcccgcataagtaagaccaaccttggaaaatacgacggcattctccgccgggattgtctcttttccttccctgcctgctccatccgaagtgagacttcccgtctccgctactggatgctccgtgatcgacgattccatgtcaagcacagtctcgatacggttcatgcaggcaatggatttgttgatgttgataatcaggttggccagcttgattaactccactaagatctgggacatgtagctcaccagcgccacaacctgtccctgcgtaatgttgccattgtccacgcggatcgctcctacccataccagaacgacgatcgctccgttgatgataatataggtaagcggattcatgagcgccgagatcttgccgacatagagctggatctttgtcagcgcctcattgtcttcgtggaactgtgcaatctcatcctgctccttgttgaatgcacggatgactctgcttccggtcaggttctctcttgtgatgcccagcactttatcgagtgccgcctgtacttttttgtacagcggaatactgaccagcatgatgccaaacacaaccaccgacagcagcggaatggtcacaacgaacacgagcgccgctttcacatcaatcgtgaatgccatgaccatcgctccaaacacgataaacggcgaacgcaagaacaggcgcagaacgaggttcaccccgttctgcacctgattaacatcacttgtcattcttgtaattaacgtcgacgttccgacggtatccatctcggtaaatgacagcgtctcaatatgttcaaacagagcatgtcttaatcctgtcgcacagccaaccgccgctttcgccgcaaaatactgcgccgtgatggcacaggtcaatccgatcagcgccaggagaaacagtaccagactcatcttcataatatatggacgatcggcatttgccaccccggtatcgatgattgccgccatgacaagcgggacaatcaattcaaatgaagcttccaggagcttaaaaagcggtcctaaaatactttcttttttatagtttcccaaatactgcaataactttttcatgatactccttcgtgtcctatgcttttaaatctttcattttctgaagtccgataatcagcgcaccgccgatcacgaaaaacaggatgttaaaatcatgaagcgtcattgccggctgcggtacctccaacgtggtcggtcccatgacaaccgcgtagattgatcctaacatcagaccgatgatcagatagatcgtctgtgcccggaaatgatctaacgccttgcggatcagctttaccacaccaaaaataccgacgagaacgccgcatccgaaaataaacaccgtcggaaatgcagcaaaattcagatgaagaatatctttgatggcagtcaccaccggcagatacagtcccatgattaaaagaagcgtcgagcccgaaattcccggcagcaccatcgcacagatggcaatcattccggcaaggaatacaaacagggcaagccccggcgtcagatgctccaggctgacaccctctccgccgctgctcggattaaagtaagtaatcgcggtcacgattgcaacgccaatcagcacaaacggaatggcagatttttttgccgcaaggcagttcttttcttccctaaagataatcggaatggcaaaaataataaatccgataaacagggaactgattgcatagatatgagcgtcaaacacgctcgcaagaatcaggatggcgagaatcattccacagacccagccggttccaagcttaatcaggaagaacagagctgctttctttttctccctgcttccggttatcagatcgtcgatagaatcaataaactggtcataaaaacccaacaggaaagcgacggttccgccggatacgccaggtacactgtctgccagtgccatgcaaaatcctctgataaactgcactaaatacatcctttatacctcatttttctgttatttttctattttattcactacaggtcaaaatctgtccaattagtggatatactgctccagcttgtgcgactcgtctaacacactgtgaagcagatccttggtattttccgcattgccgagattcttaacactgagatccgccgcctgcacagaagaagctgtaacttcctccgtcgttgcggagagctgcatgatgttctccacgatctgattgttcgccttggagaggttgtttaacatagtgtcgatctcaccgatgtccgtcacaagctcattgacattctggttcatggcgccaaagctctcggatgcctgcgcaatcatctcatcctgcgcacccgccgccgtcacagaacgctccaccgcatccgccgccgtctgggcattttcagacagctgctctaaaatgttggcaatattctccgtctcctgcctggtcttctccgccagctgacggatctcgtctgcaaccaccgcaaaacctcgtcccgcctcgcctgctctcgcactctcgatcgatgcgttgagcgccagaaggttggtctgactggaaatagaaaaaatggtatctgcaatacttttgacagcgcttgtacgatcctggagttctctcatagaggaagccacctcggagtttgtctgtgcaataactgcggactgcttcttcagatcatccatgattctggaactcttctcattcagctctccggactgcttcgccacctgtaccatcttctccgaacgctctaacgtcgttccgatggagtcctgaatattctgcgtcatctcggtctgcgtctggatattctcggcggtactctgtgtactgtccgaaatatccttcatggcaccgttgactacctcggtggaactattcagttcattgacaatattcatcgcattctctgttcccttgcgcacctgatctgcaaccgcaatgatatcgtccaccatctggcgctgtgctgcttccttttctgtcaggctgccaatcgtatcgcggttgaactggtacgccacggatactgtcagataaaccactaccatcataagtataattgccagcgtcgcacaccactgatccagtgcattctcgccctggtatgtgtgaagcgccagcgtctttgacgccgtcacaagaagattcaccgccgatacagcaatcccggaaaaggcggcaaactttttatcgtaaaacagaatacatgcaaccaacggaattgcagccataaaacgcacataataattgtcaaacgcccatcccatcacaaacgtaatgacaagcagcccgaccgtcgcaatatagcggatcttcggatcatcttttctccgctggtacaacacgagtgttcccgctgttgccagaataatcaataccgcgatcataacggtatatccaactgtgcggattcctctgaggcaggcaattcctaccacacaaagcacacagagataaaacacgatatatccgatagccaggaaatgattggcacgtttattctgttccacagtatctgcatacaaatgcttctgttcctttttctccataactttcacctttcttctttcgataactccatataccatttcaatatatcatactttatccggcatgaataatattttttcaatttttatttcttttttgatgttttatctgtcccttttccacagtctgtggcaatttcgcctcgcagcatccacagacagagcagattcggcagagccatcagggaattcagcagatccgatatcccccacacaagctccatggaaagcaccgctcccagataagcgaaaaacatgtacgccacctggtagacacgcacccccgcctcgccccacaggtagcgcaccgcgcaggttccgtacacgttccagccgatgatcgtggcaaacgcgaacagcgtcagagagatcgagagcatccactcaccgccgacgggcaattcccggaatgccacaaaacacatattttccggtgccactccccggtattcctgcggatggcttaccatgctgccgaccgccgcaattcccgtgatcgcacataataccaccgtgtcccagaacggtcctgtcatggagattaacgcctgccgcacagccgcctccttcgggctgtcagaggaggatgctgccgtcgccgcgaccatcggaatcgagccaagccctgcttcattggtaaacaatccccgggagactcctgtctggatgccaagaagcagcgctccgccggtgcagccgcccgccaccgccttcgggcagacggcggatgagagaatcagcgctaacgtctccggcagcaccgccctgtttcttcctataatatagagacagccgcccacataaaaagcgctcatcagcgggacgagccacatacacacctttgcaatctggctgtttcccccgatgataataatccctgcaagccccccgaccgccattccgaccagatgcggcgacacggtaatctgatgctggagcgccgtgcgtatggagtatgactgtacgctgcttccgataccaaacgatgccagcagcgtacatacagcaaacgccgctgccagttttctttttttcagacgccgatccaaaatatacatcggtccgccggcaaacgtactgtctgtcctgcgcacccggtatcttatagagagataacattccgcatagcaggtcgcaatcccaaataccccggtcagccagcaccagaataccgctcccggtccgccgatggcaatggctgtggaaattcccacaatgttacccgtaccgatcgtcgctgcaagtgccgtcgccagcgccgaatacggtgttacctgatccttttcctgattcttcgttccggtcagtgacaaccggattcccaacgggatttttttctggatgaagcccaggtgaaatgtgaaatatagatgtgttccgaataagagcgcaagcatgggaaatccccacagatattcccgcgccaccgccaccgcatgctgcaataatgccataaaaattccccatataccctgcatcacaaatatctgtaaagtatatggggaatctgtttttcccatgcattcgattgttctatgcttctaccagatgtgcgattgcatgtaccagctccttgatgtcatagttggaagtattgatacacagatcatagttgagacggtctccccaggtctgtccggtaaagaactgatagtaacgcgccctgcgcttatccacgtctaaaatatggcgctttaattccttgtccgtaaagtgctcgctctccggcgcgcgcttcttgcagcgttccatcttgtgctccatctccgcatagacaaacaggcggaacggatgcttctcgcgcaaaatataatcggcgcttcttccgacgatgacacaatcggacttctccgcaaattcctgaatcaggcggctctgctcacggtagatcgcattattctgctccatgattggatcaactcccatgtaaaagcttctcccgatcgtaatcggatacaacgtcgacggaccgttctccatcacatgctgcacatagccctccgccagcttcgtacggtctgcaatctgactgatgatctcattatcgtaataagcaattcccagctcatcggacaatctctttccgatctcacgtccgccgctgccaaattctcgtccaatcgttataatcctagacattggtatctcctttcccctgtgtggggtttgtttttctatctaaaactatagcatttcttcctgcggttcgcaactgcaaaagctgccgccgcagataatagccgatccctgccgcatcatctgcgtctgtttgcctccctgacgccttttcttcccggcacttacttattcaagaaacggtcccaggatgccgtattgtgtgtgccggacaccgcaagcacatactcctcctcatcgggcgcatcgatctcaaatatatagttctccccgtcccgctttaacgcatagagtgtgccgtccgcaaaggagcggatcgtctcgttccacgccgcctcattgaccatctcatcctcgcaggttcgcatcagtatgccgttggcatcgtagaccttgtatccctcccgcaccagggaccggatcaccggctcctcgatctttaacaccagatcgttcgcgcgcatctcgcggatatccctgttgcaggaattctccggcagtatcgtcacgtttgatagtgtcatatggaaaaatccgcccgtcacctgcacgtcggcaatgtaagcctccgtgaaagaaaaatgttccagttcatccgttgtcgtatatttcatagtgttcctccgtatctcttccctgttatttctcctcccctattatacagagccgtccccgttttttccaccaaaaagagtaacattgtctatgtctccggcatggaaatcttatcgagaatccccgtcagatgcgcgatcgtcacgccgtagttcgtcatcggaacgccctgctctctggcgcgctcaatccgcgacatcacatatttgcggttaaacatgcacgcaccgcactggatgatgagatcgtagccggagagatcttttgggaagtccgtcccgctcacaatatccacagcaaccgactcaccgaagcgttttctcaacatccgcggaatcttttctcttccgatatcctccttcagcggtgcatgggtacagcactccgcgatcaataccctggaatgggcgttcagcgcgtcgatatgcctcgcaccctccacatagtacggcagatctcccttatacgctgcaaacagcacggaaaaggacgtaagcatgctctccgccggtttgttttcgtagacatagccaaatacctgggagtcggtaatgataagcttcggtgctttttttaataccgcaagcgccgggatcagctggtcggtcgtcacactcatgaccaggcatttcttatcgagaagttcgcgcagggtctgtacctgcggcagaatcagccttcccctgggtgcctggatatcctgcggcatcacgagaagcaccagatcctcccggccgaccagtgtcccggtgatgaggcggctgccgtaattctccggcagtttgcggatcaatgcttcttttaatgcctccatgccctctcccgtcttggcgctgaccggatatgcctcctcaccggtcttcccccggatggcggctgccagtttatccacctgtgcgtccgaccggatgtccgttttccccacgacgaaaagtaccggcgtcccgtgctctttcaaaaagcggtaccagtgcatttcttcctcatcaagcgccgcgtcaccattccccgccacaaggagcagcgcaatatccgtcttttccgctgcgagacgtgtcttttccatgcggcttttgcccagttcgctctcgtcgccaaatcctgccgtatctatgataatgcacgggccgagcggatgtacctccatcgccttgtagaccgggtcggtcgtcgttcccgccacattggcgacaatggatacctcctgtccggtaaaagcgttgatgagtgcggatttcccgctgtttgtttttccaaatattcctatgtgcagacggctgctgcccggcgtctcattcaatgtcactgccataactttctttttccttcctgcatacgaatttccccttgtccgtattacatccatatccggcttccagcggctgcccgatcccagcatcgcttccggctatcagaagcggaagtctctctttccctctgcaatatcatgaatgtgctcgtaggcggtctgctttaccttcggattcggaatcttctcaagctcacggtcaatcagttccataccgatctttttcgtctcctcgcccgcataatcctcgaggtattcttttaaggtcatgagcgcgttcggatgacagcagtttaagatctgcatatttttgcagagcgccataaaacggtcaccggttctaccctcgcggtaacatgcggtgcagaagctcggaatatagcccattttcatcagccagttcacgacctcatctaaggtacgctgatcgctgacgtcaaactgctcggaattctcctcctccggctccggctcggcataaccgccgacactcgttctcgatgcaccgctgatctgcgatacgccgagcgggagcactttctcacgcactgcctgactctcgcgtgtggagatgatcattcccgtatacggcaccgagatgcggatgagcgcacagatctttgcaaaaatatcatcgctgataccgttgtcaaaagcagtcggatcaatgtcatcggcatgtttgacacgcggcacgctgatcgtgtgcggtccgacgccgtgcacggcttccagatgctccgcatgcatcagaagtccggcaaattcatagcggtacatctccagtccgaacaacacgcccagtccgacatcatcgatgccgccctccatcgcacggtccattgcctccgtgtggtacgcgtaatcatgcttcggtccggtcggatgcaggttctcataactctccttgtggtaggtctcctgaaacaggatgtaggttccgattccggcttcttttaacttgcggtagttctcgaccgtcgtcgccgcaatattgacgttgacacggcggatggctccgtttttgtgcttgatactgtagatcgtctgaatacactccagaatatattcgatcggattgttcaccggatcttcgccggcctcgattgccagacgcttgtgccccatgtcctgaagtgccgtgacttccttcacgatctcctcctgtgtcagcttctttctggctatgtgcttgtttttcaggtgatacgggcagtatacacagccgttcacacagtagttggaaagatacagcggtgcaaacagcacaatacggttgccgtaaaagtctttcttgatctgctgcgccagcgcatagacttcctcgattttttccggaatctgacaggcgagcagcaccgatgcctctctgtgatttaagcccttgcgctctcccgcttttgcgatgatcgcgtcgatcagctccacattgtccttgttcgcatccgcgtaggcaagcgtctcccggatctcctcatcgttgataaattcctctgcttttaatgattttgcgtcatacttgtacataatttttcctttctttccggtcagttcatgcttcccggtcagtgtttttatttttattgtaaaccgcaggacggtaatccccgcggtcggtaaccacttcatagccgatgctctccatccgcctctgcatgcagaaacgacattctgccgcctcatcccccgtgcagatcttattgtcgtaaagcttatatttttcccgcacggaaaccggcgagagattcggcatcaccacattggcgccggacagaattcccatttcccttccctgcgggtggatcgtgccgagcgccgtcgtcgccggaagcagcacatgcggattcatcagccgcaggatggaaagcagccgcagggtcatctccaacgtccccgcagtctccccgccaaacggcgtgtccttctgcgggatgaacggcccgattcccaccatggcgggtccgagctccttaataaacatcagatcttcatacagcgtctccgtggtctgatacggtgagcccaccataaagccgcagccggtctgatatccgatctcctttagatcccgcagacagcgcatccggtttttaagggacatttcctccgggtgcagctttccgtagtgcaccgtatccgccgtctcatgcctgagcagataccggtctgcgcccgcgtcaaaatatgcctgataactcgctctttctttttccccgatcgagagtgtcactgcacagtccgggtatgcccgcttgatcgcagacaccagaccgcagatcttctcatctgtaaaataggggtcttctccgccctgcaggacaaaggtgcggaatccaagctcataccccgccgcgcagcaggtgaggatctgctcctctgtgaggcggtagcgctcggcacatgcattgcccctgcggatgccgcagtaatagcagtcatttttacagtagttggtgaactcgatcagcccgcggatatagatctgttttccgtataccgactgtgccgccattctcgcctcagccttaagcttctcgactgtctctgtatcttctgttgtaagtagacagtccagttcacccaccgacagcatcttctccgtcttcaggtgctctatgattttttcctcgtgtgtcatataaatctccattccgcagacgcttatacattggaatagacggtctttgccgtgattcccgccagccgtccgatctttcccgacagtgcattgatgacatcctgcggtgcatcgatggcaacgctgataatgtgaacatttttttcccggtaagggattcccattctgccgatgatatggctcccgtattcgtgcagcagatgattgagctgctccacggactcggtgctttccacaatgataccgataagtgcaattcttgtctccatattttctcctaataaaaaagaatcctgcctgcaggattctccgcctgcggcgggtcgctcttgcgacatctttcgtctccgccgcagtgcgatccccgaagagtttttatataataggaacgaagtttcctattacataaaaaaaccgtatctgaaatctcccctcagatacggcactcgctggaaatacacggcagaacctgccctacagggcatggaatatcccgccggtatcctatctacagcatctgctccgcacacacagaccagatgcagactctttcatgaccgccatatcttccgccgcaggcactgcttttggcgtcagagacttttgttaaggcaagacagcaagaacgtatctcactgcaatgctgtttcagcgtatcatgaagtctgttccctttcaagatctttcgttgtattttttgtgaaacaattcacaatcttttctttttccggtggatcaaaaatcggttacacggatacgtccagagcatcgggatcagcattccgatcaccttgattgccatgtcgcacagattccccgtcagatcgttttccctcgcccaggtcgtcatcgccgatccaatccagccatttgcaaagattgtgaacagtaccatgaccgcatagagcatcatgctgactgccggattggcgtccgcattaaaagtaatcttgcggttcaatataaacgcaatcgtataacccacggtcgttgaaatcatataggtatacagatatccctttgacgtaatgccgatcaggttgagaaaatgcgcggttaccggttccaccgtaagcgcagcaaatactgtgtttaaaagcagcatatgcaccgccagctcaaccatgttggaaccgcctcccgcaagcaggaacttcataaacttccacagttccgcatgtctgtcggtccacgccgtaaatccgcttttctcctgtcgtatctcacccattgttttctccttttctgcacggtatttttcttaccgggctgcccttgttctgccgggtgctttccccatccctctacaacaacaagactgccagcacaatcacaagtgccagaaacagcaccgcttttaaaatcatcggaatcgccgcctcaaacgtggcaggtgctttgctggtcagatagtcaaataccgggcgtgacacttttttccccaccagttcctcatacgttctggtataagtatggtattcacacggctttttttcgctcaatacaatacagcgcacgccgcgcttcgtacggttgccgtagacattaaatcccgcggacggtgtaaatccaagcacaatgttccggtaacgccccacgaagttgtttttatgatcgtgtccgacaaatgccgcaagcacttccccgcactccgaaagcgcctcaaattccccggtattgacgtccggtaccgacggcggttccagaaaaatatccccggcgccgcaggtttctcccagcttataatattcgttcttatgtgtccgataagcgcgcaccgcacctttttccccacggtcaacaagctttaacacctcataatattcgcgcatcgggatatgctgaaatacgatggacggcacatacattccatttttctcccgaaggtcttcccgctgtttgcggtaccacgcaatgatcttcggatcgaatgcctcatagccgccctccctggcatccgttccgctgtcaaacagatatagttcaaacacatcccgcccgcttccgtcggatgcctcgatgggaatggcacaggttcctcccccgtcaatcccttctgcctgctccccgatgcaattcggaagccttttgtaaatatgatagaactgatcctgattggaaatcccgacctggcagtcatgattaccaaatgtcactgcaaacggaatgccacgctttgtcaccggctctaataattttccaatcgtctgtgctacctcccgctccagctcctctccttttcccttgtaagtcacaccatagcccttgatctgatcaccagtgtagacgacaagatccggctgctcctccagaaccgcccgctccatcagcgcgatcgtgtctttcgatattgcgggaatttcctgcatatctgtaatctgcatgattttaaaagtaccgtctttttgaaatctcaatttcatccttattctccgtggtgtaaaaaagggagactgcgcccctgcatgtctcccttgaccttttcttagttatcttcccaaaaatgctgttccagatctgccgataatgatgaaatctcatcgatttcagccgaaatgctgcggatggaatcattctgcgacgtgattgtgtccgtgatattctggatggttgcagaattttcctctgaggttgccaccagcgtctcgatctcctgctggatatttccaaagtgttccttcacatgttcaatgatcttatattcttcatcgacaatctggctcgcctcatccgtcgcatcattgatgttactaaaataatccatcaatccgccgaccagctccacactcgcggaagcagcatcggtgcccgccgtgatttcttttgagatctgcccggtcgtatccgtcagccaggtcaaaatctcctgaatgttgttcgccgccttggcactctcttctgacagcgcgcggatctcatctgcaaccaccgcaaatcctcttccgtgttctcccgcacgcgccgcctcaatagatgcatttaacgacaacagattcgtctgggatgcaatggaattgatctctccgagaatcgatgtgatccggttcatctcggtaagcagcgaatcggtcgattggcgcgcggaatcgacggtctcctccatggaaagaatggaactctttgccgtctgtatcgctccgtttcctttttctaccgcactctgcaccttctgaaatccctgatccagagaaactgccagttcatggttccggttaatctctgttgttgccgcattaattttatccatcacgctgacagttgcattagcagtatcctcaaccacctgccccatctgcgatgccgccgatttcacgctggagctgccgtccgcaagcgcatgcactgaactcatactcttgtggatcgtggtgttcagattcgctgaaatcgtattggcgactttcgcattgttctgaacgatggaaagcgtctcttccgttttcttcacaacacccgcaccgcgcttcgtcgcaaaataaagcaggatcgctgtcacgataaacaaaaatatacgcgtcacgaccccggccatcgtgtagtcaattcccgcgatggtctcggggctgaaagccatgaatacgaccgaaataacggcaaacggcactgcgaaatagatgataaccgactccataaaataggaagttgtcatcgctaaaagtacaaaattcgccagatacggaatcgaattgccaccatatacccacgaatacaacagcgtaccgatcgccggcggaaatacaagaatcagcacttttttcgcatcgtcaatcggaaggtaacatccaatcgtagaaataattcccgcaactaccagaattgcaattccacggattgcaagcacggtaaatccgtatcccatcaaagaaacaaggctaagtgcaataatcgagcaccagacaataaccaaattctgcctgtgcaatttttccatatcatgttcccttctaaagaaaacctatcatcatgtacgcgtctattatatcatctttttgcgctgctttctgcacatccgaagttccaccggaacttctaatatgaatccggtaggattcattatgtcatctttttgcgctgctttctgcgcacaatatgaactcgtcagagttcattataccgcaagatcagatcaagaacaatattgcaacttcaggctttttcggtaacttcaggctttttcggtaaatcctgaggttgacacgatgttttcggtaaattctgggacggacaacagtttctgcaacccctaggcggcgtgatcttttcttctttttcgggtctaacgtggcgttttccttcttccagacccggctacgacttatttttcggcgttatgtaaacttctttctctcccgcaagggtctagcgcgtgaaaatcagtctctcggacccggcttgtctttcttcccgggtctggcgcggcattttctttctcccagacccgaccatgacttgtttttggcgttatgtaaacttcttttcctcccgcaagtgtctagcgcacgaaaaatgggctcccagacccggcttttcttccttcccaagtccagcgcacgaaaatcaggctcccagccccaacttttcttcctccccgcatccagcgcacgaaaatcagtcacacagcccgtccaaagctcgtttttcgtcattatgtaaaccttttttcacgcgccacgcattacaacgttccaaacgaatacccctgcgtctgcgccgcatcgatcagatctcccagcaccgccgcatttgttgccgactccgcatgcagcagatagatggctcccgggtgcatcttatttttcatcttctgcaggctttccgcctgatccggctggttgtccacatcgtaatccaggtaggcaaaactccagaacacgctctcgtatccgcagttatttacaacggcgagcgactgctcactgaactttcccgcaggatagcggaacagattcatctcatatccaaaggtatctttgatatactggtggtttcccatgacctcttcctgctgctgttccactgtcagcgaagggattcccgccgacgggtgcgtcacactgtgattgccgactacatgcccctcgtcaatcatgcgctgcaccagtgccggttccgcctttgcataaggctccgtgacaaaaaagacggcatgcacgcccttttccttaagcgtatccagaatggattccgtgtacccgtattcatatccctcatcaaaagtcagatagagggtctttgtattctctccaatgaaaagcgcatggtaatccccatacttctgctgcgcactgactgcatcgttcgggcggttgtccgcatcggtgtggcttcccagcccccagctctgcacggtggtatccagcccgtcaagcgcaatcgtctgcaccgccgcatttccacctgcagcactctgaccgtctccggtgctgcttcctgtttggtccgccctctgtccgtctccggtgtcatttcccgttccatccgtgccctgatcgtctccggcgccgtctcccgttccatccgtaccttgaccgtctccggtgccgcttcccgcttcgcctgcgccctgaccgtttccatccgtaaccttgttggcacggtatgtctccgccgttgcaagcactgcgtcaccgatggcggcagcgtacgcatccagcttttcatcgaaaagctggttatcggatgcatcgttgataaatcccatctcgacgatgcaggacggcatgtccgaatgtacattgatataataattggaggattctccagtctgggttccctttttcacgccgcggtttctctggattcccgccgtatccagcacttccataatgtggtttgcgagggcatccgtctcctccgaaccactcgccgagatccaggtctctacgccgttaccctcgccgtcattgcggtgcagcgacagcatataatccgcaccgctctgattggcaatcccgcaccgctctgacaggcgcaaaaacgtgtcatccgacctcgtcataaccacttttacatttttatcagccaaataagctgacacagcctgtgccagctttaaattatcatccttctcataacgccccttataatcggagccgttgtcttttccgccatgtccggcatccacgcacacgatcaggggattctcctctgttttcgtctcctccgaccagattacctctccctcaatctcctgcgttgcagactgcgttccctgcatcagggacagcccccgtcccaacagttcaaaccctgcgatcacgagcagcattttcacaatactgtactgtatacataccagattccgaattcgtcttttctgtctctttgttacattcacatcacttcactccttggattcctacgattctattttagtcctctttccgtgaaaacgcgaatgaatctttatgaagaatttcttaatatgaatccgtccggattcatcgttctaaagtaaaaactgtgccagagcgtaattgctcacatcctgcccgcgttccgtcaaataaatcctccccgcgcgtttttcgagcagtccttcctccgtaagatgcagcagcacctcctgatacactgcctcaatctgtgttccaaacgtctgtgcaaaacgttccctggaaattccctccatcatgcggagtcctaaaaacataaactcttccatctgcccttttcgtgtaatgcgctctgccgaagcatgcagattcgtggccggaagctgttccaccctgccggatgcgccgctcccctggctatccgttatctcattctcccagataccctcacgaatatgtctggtttcttccagatacacatacaattcccgcgtgttgctgtagcggatattctccatcagagacgacgcgccaagccccagtcccagataattctcccgctcccagtagccgatattgtgccggcacgcataacccggttttgcaaaattagaaacctcatagtgcacatatcccgcttccgcaagcacctgctcggtcagcttggtcatccggtacacttcatcctccgtcggcagcgccaccgtctgcattcccgcctgctgcttgaccgcgtcaaacttatacagatcgtaaaatggcgtccccttctcaatgatcagggaataggcggaaatatgctccggtttcagccacagaagctgctgcagggtgcgggcaaaactctctgccgtctgtcccggaagagaactcataatatccacattgacattgtcgaatccgtttttgcgcgccagctcgtaagtcttcaggaactggtcaaacgtgtgaatccgcccgagaatctttaattcctcatccacagccgactgcaggccgatgctgatccggttgattcccgcattccggtagccggcaaacttgtgatcggtgacggttcccggattgcactcaatggatatttccgcatccgacgccagacgaaacgaccggcgaaccgccgacataatctgtgccatccactcctctgtgagccacgatggcgtgccgccgccgatatataccgtcgataccaggtagtcgctgcaatgcggtccgtaatacgcaatctcccggagcagcgcctccacgtaggctgcctgcgttgcctcgtccgccgcaaaggaaaggaaatcacaatactggcattttttgacgcaaaacggaatatgaatgtacaattccattgttttctgactcactccacacgccgctcctttcccaaaaatattcctgacactgccatcactgacgctgcattttccgatctgttcctttaatcttcatccagcttcaagacgctcatgaatgcctcctgcggaatctctacatttccgacctgacgcatgcgcttcttgccttccttctgcttctctaaaagctttttcttacgcgaaatatcgccgccgtagcactttgcaagcacatccttgcgcagcgccttgactgtctcacgggcaatcaccttgccgccgactgccgcctggatcggaatctcaaacagatgtctcggaatctcttcctttaacttctcgcacatctttctgcccctgtcgtaagcactgtccttaaagacgatgaacgagagcgcgtccacctgctccttgttaatcagaatatccagcttcacaagctcggaacgctcatagcccttcagctcatagtcgaacgaagcgtatcctctcgagcgggactttaaggcgtcaaagaaatcgtagatgatctcattgagcggcagatcgtacttgatgagcgcacgggtctcctccagatactccataccgttgtatacaccgcgccgttcctggcaaagcgtcataatcgcgccgacatactcgctcgtcaccatgatctccgccgaaacgaccggttcctccatatactcgatctcggacggatccggcagattagacgggttcgtcagatcgatcacctctccgttcgtcttgtgcaccttatagataacgcccggtgccgtcgtcacgagatccagatgaaactctctctccagacgctcctgcacgatctccagatgaagcagtcctaagaaaccgcagcggaatccgaagcccagcgccagcgacgtctccggttcatactgcagcgacgcatcgttgatctgaagcttctccaacgcatcgcgcagatccggatatttggcactgtccgccggatacatgccgcagtataccatcggattgacttttttataacccggaagcggctcctcacacggatgtgcggcgttcgtcaccgtatcacccacgcgggtatcccgcacatttttgatgctcgcacagatgtagccgaccatgccggcagacagttcgtcacacggaatgaactgccctgctccaaagtaaccgacctcggtaacttcggactgcgccccggtcgccatcataaggatcggatcgccgacccgcaccgtgccctccttgatccggcagaacacgatgacacccttgtaggaatcatagagtgcgtcaaagatcagcgcctgaagcggcgcttttggatcgccggccggcgccggaatcttctgtacgatctgctctaacacctgatcgacattgagtcctgtctttgcggaaatgcgcggcgcatcctccgcctcgattccgatgacgtcctcgatctcctttacgacctcgtccggctgcgcgctcggcaggtcgaccttgttgatgaccggcattacatccagatcatggtctaacgcaagatacacattcgcaagggtctgtgcctccacgccctgcgccgcatccacgaccagaatcgcaccgtcgcatgccgcaaggcttctcgatacctcgtagttaaaatcgacatgtcccggggtatcgatcagattaaaaatatattcctcgccgtcgttcgccttgtagataatgcgaaccgcctgcgacttgatcgtaattccgcgctctctctccagatccatgttatctaacacctgcgcctgcatttccctgctggtcaaggttcctgttttttctataatacgatcggcaagtgtagatttaccgtgatcgatatgtgctatgatacaaaaatttctgattttactctggtcaatcgacattcatttcctcctgcccggtgcgcatcacttctgccctccggcagccacacgcatcacttatctgcaatattataagggataaaaccggaaaacgtcaagggaatcgcggttcgcaaaaaccacgcaatttatttgcaaaccgcgcatatatgagcaaaatttcacaattttacactggatttttccccagaatatgatatgatatcaacgtcgatatttatcggcatgggttttggtgaataaaccgagaaaacccccttcttaagcgaagaccccctgctacggtggctgcaaacaccataacaggggttcttcttattttatgtatcatatgataactcagatatcttttccaaagtcaagaccgctcttctcgcgcttctcttcctgcagtgcaaccagatccgccagtgtgatatgatccacgacatcgctgatcgcctggttcagccgcttccacacctccacggtaacgcaatccacttcgcgttcgcaacttccttcctcctccacgcaggcaaccggcgcgagcgatccctccgtcagacgcaaaatatcgccaaccgtgtattcctccggtgctttccgcagcgaataaccgccctgcggtcctctggtgctccgcacataacctgccttgttcaatacggatatgatctgctcaagatatttgtctgagatctgctgtctttccgcaatatctttaatgcgcacaacgttgttctcaccgttcatcgccagatccagcatcaggcgcagcgcatatctgccttttgtagaaattttcatattcgttcacactaacacctttcctgcttctgccagtccagaagatcctgcaatgtcacatgatcgaccacgtcccggatcgccttatcgactttttcccagagcatgatcgtcgcgcatttctgctgtttggggcagggattctcggcgttcgcaagacactcgaccggcgcgagcgatccctccgtcagacgcagaatatcaccgatcacatattcgtccaacggcttcgtcagacggtagccgccctgaaatccccggctgctggaaacatagcccgccttgttcagaatggaaatgatctgctctgtatatttgacggaaatctcctgtctcgttgccatctccttgaccgacaccggatgctccgtgccgttgaccgccagatcgtacagtatgtggatcgcatagcgtccctttgtcgtaattttcatgctatcgggcccctttcatcctgctggcttcaccgaacagctcttcaaaatcctcttttaagaagcggtgataaaacgcatgtccctcgtcgaacttgacgcagtacagataagaatccggattgccatcctcaaagtagcacacgtcatcaaattcatcgcttttgatctcaatgatacgagcactcttagaatagtgccggaacagctcccacacctgctctctcgtcacatcatgtctgccgaagcagtcaatcagatcctttaagaacggatgcgccacgccgtgcgcatgcacatactccgcacccgctgcaggaatgagaaaacagattctcccgccgctcgccccagatactgccacttcaccgagggtatccgccgcatatgcgccaaatccctccagcgccgcaagaaccgccggcttggagcggtcagacagctttaacacatgtccgattgacgacgatggtgaataaaaccggatcgtctcacgctcatagccgagctttagctgttcctctaagatcatgtcgcataaatattcttttaatgccgtatagtccgcttcatcctgccgattcattcttagtaatcttcctcttccagaccttcgctgatatcgttcttcggcttctcaagaccttcgatcttgatgttatgcttctctgcgtaatcccagagtgccgcatgaattgcctcctctgcgagaagagaacagtgtacctttacaggaggaagtccgtcaagcgcctccataactgccttgttcgtgatctgcagcgcctcgtaaatggtcttgccctttacaagctccgttgccatactgctggttgccacagcagcgccgcagccgaatgtcttgaacttgcagtcacggataacctggttctcatcaatatcgagatacatacgcatgatatcgccgcactttgcatttccgacggtgccgacaccgcttgcgtcctcaatctctcctacatttctcgggtgctgaaaatgatccataaccttttcactatacataacatatacctgctttcttttttatattatttgtttttcttgatgaaatcctcgtacagcggagacatctctcttaagtggttcacaatctcttttaagttgtcaacgacgtagtccgcatcctccatcgtgatctggtcgctgatggtcagacgcagagaaccgtgtgcaatctcatgcggcagtccgattgccagaagtacatgggacggatccagggaaccggatgtacatgcagaaccgcttgatgcgcagattcccttggaatccagaagaatcagcatggactctccctctacgaactggaagctgaagttcacgttgttcggcagacgcttcacacggtctccgtttaactttgcatacggaatctccttctcgatgcgctcgatcaaatgatctctgactttgatctcctccgcagtgcgctccttcatgttggccgtagcgatctctgctgcctttgcaagaccgatgataccggttacgttctcggtacctgctcttctgtggcgctcctgtgctccgccgtggataaaggatttgatcttcacaccttttctgatatataagaaaccgattcccttcggtccgttgatcttgtgaccgctggtgctcatcatatcgatattcattgcctcgacatcgatcggcacctgtgtgtatgcctgtactgcatctgtgtggaacagtacgccatgctcatgtgcgatcttaccgatctcagcaatcggctcgatggttccgatctcgttgttcgcgaacatcacggagattaagatggtgtccggacggatggctgcggtaagctcgtccagctttaccagaccgttctcatccacatccaggtaagtgatctcgaagcctttcgtctccagatactcacaggtgtgaagaatcgcatgatgctcgatcttcgtcgtgatgatgtgctttcctttggacgcataggcatctgccgttgcctttaatgcccagttgtcagactcggaaccacctgcggtaaaatagatattctccggcgtggtgttgatggtcttcgcaatgacctctctggcatccgtgattgctttcttattctcagaagaaatgctgtatatgctggatggattaccgaacttctctgtaaagtacggaagcattgcatcaagcacttccggtttgaccggtgtggtagctgcgttatccatgtaaataagtttcttttccatattctcgtaccatttccttttttatttcatatcatacccatatgatatgatttatactagtatcattttttttatttgtcaactgcaaaatacctgcgggagatattgtacttcattatatacaaaaagaggacgttgcacagccgccccgacggtgtaacatcctctctttatgcatctttcctgcagtttctccgaaaaaatccagttttctcttcaccgcatacgattccttaaattaccttccgtatccccgtaggacttcacaggtctgtgcgatatcctccgccgtatgtgccgcagagacaaacattgcctcgaactgcgacggtgccagatatatctgatgatccagcatataattaaagtaatccgcatatctggaaatatcggaggacgttgcagtctcataatcctttactttctgggcagtaaagaaaatgctcatcagcgatccgatctgattcacgcagacgctttcgccaaaatgtcctcgcatgccctccgcaagcgtcctcgcacttgcttcgatctgtgtgtagatttccggcgtctcttttaagatggtaagcgtctctatgcctgccgtcgttgcgatcgggttgccggaaagcgttcccgcctggtataccggtccgaccggcgcaaccatatccatgatctcttttctgccgccgtatgcgccgaccggcatcccgccgccgatgatcttgccgagcgtcgtcagatccggcgtcacatgaaaatatccctgcgccccgccgattccaagacgaaaaccggtgattacctcatcaaaaatcagcagtgccccgtaatcttctgtgatttttcgcagaaattccagaaatcccggctccggcaaaacgactcccatattggcagccaccggctccacgatgatcgcagcgatctcttttccctgcgtctcaaagagcttctgcaccgaatccggctggttgtactccgccaccagcgtatttttcgtataatccgccggcacgcccttgctgtccggtacagactgtgtgagcgctcccgatccggcttttaccagaagtccgtccgaatgtccgtgatagcatcctctgaacttcacgaccttatcccgtcccgtaaatcctctcgccacacggatggcgctcatcgtcgcctccgttccggaacttaccagtctggacacttccatcgacgggatacaggaacggatcagctctgcaagctttagttcctttcctgtcggcgccccgtatgtcagcccgttctcgcacgccgcctgcacggcttttattacgcgcagataggcatgtcccagaatgcacggtccccaagaacacacatagtcaatatacgcgttgccgtccacatcatagatgtgggaaccgctcgcccgctccacaaagaccggcgtccggtgaaccgcctgataggcgcgcaccggactgttgacgccgcccggaatacatttttttgatgcctcaaataatcgttctgattctgtatactgcatatttctcctcatttccggcactgctgccattctcttccactactttctctcctcgtccagccactttgccacatccagcgcgtgataggtgatgatgattttcgcacccgcgcgtttgatgccggtcatgatctccatcacgatccgccgctcatcaatccagccgtttgccgctgccgcctttaccatcgcatactccccgctcacattgtacgccgccagcgggtaatccgtacggtccatgacctctcttacgacatccagatacgcaagcgcaggctttaccataatgatgtctgcgccctcctcaatatcggacagacattcccggatggcttccctgcggtttgccggatccatctggtaagttctgcggtcgccaaagctcggcacggaatgtgccgcctcgcggaacggtccgtaaaaaccggatgcaaactttgcgctgtacgccatcagcatggtatttttgcagtcgttctcatccagagcctcacggatcgccgccactcttccgtccatcatatcggatggagcaatcacgtccgcgcctgcctttacgagacttaccgacatttttgccaaaagcggcagtgtctcatcatttaaaatctcaccctcacacacaaggccacagtgtccgtgggacgtgtactcgcacagacacacatccgcgatcacgagaagctccggcatccgtttcttgatgtggcggatcgctcgctgcgtcacgccctcatcatttgtgaactacctcttcgcgtgctatgcgattccgcttgtgattttcgctacgcggctctggatggctgcgttgaaaaacagaatcacaaatgcagtaaacagcatcaccagtgcgatggacgttgcccccgcgtaatcaaattcctgcagcttcgacataatcattaacggcgcgatctccgtctcatacggcgtgttgcccgcaatgaacaccacgcttccgtattcgccgagccctctcgcaaaggacatcgtaaatcccgccagaagcaccggggcaatctcgggtaaaatcacccggaacacggtctgtctcgtattggctccgagcatgtgtgccgcctcctcatactggagatcgatcttctcaagcaccggctgtaccgaccgcaccacaaacggaatcccgatgaaaatcagcgccacagtaattcccagttttgtgtaggcgatctcaattccaaacttattgtaaaaaaaggcgcccaccaatccgttggttgttgtcagatgcgtcagcgcaatgcccgccaccgcggtcggaagcgcaaacggaagttctatgattccgttcatgatccgcttccccgaaaattcgtaccgcaccagctcccaggccaaaatcacgcccatgacggcgtccaccagcgccgcgaaaaatgcggtctaaaaactaaccagatagctggataccacacgccggttcgtgatcgtcgccacaaactcaggaaaagacatctgcgccgagaagataatcagtgaacagagcggaatcacgacaatcagtcccagcatcgttatggtgattccaaaggacagtccgactcccggaatcacacgttctgttttctgttttttccctctcatgcgacactcctcctattttcttacttttcctatctattttatatgaaatatactttactcctacttatccacactgtaaagtatgtttttgtaatttttagtaataaagtggtaaagtgacatatgatacagaggaattgccgcgataagcatagatcttgtttgggtgaataagtaatattatcagaaatagatacttaaaagttccagataaccatgcggcggtgaattttgcttcaaagaatttgccgccgtctgtttattctggaacttttttgttctctggtcttctgataatattacttattacccaaatgaggtctgtacttattgcaacaattccagctgtatttcaatgtgactaatccagcacggtcttccagccgctgctctcatatgccgcaaagcacatcccgatctgttccgccgtcactttttcttccgcaagcggagacggaagggcgtcctttgcaaaatacgcggtctccgtcgtctcaatgttttcctggaagcttccgccggtgacgctgcactgcacaaatatttttatcacgccgtagggcagattgtagcggttatgctttctccagtcgtgaaccgcgatcactttctccggcttcacgagaagacctgcttcctcatgggtctcttttaccgtgttggacgccaccgactgatccacgtcgcaccagccgcccggcagcgaccatgtcccgtttttttcatgcaccatcagtatttttccatcgacaaagacagccgcccgggtgtcaatcttgggcgtctggtatcctgtttcattgcagaaaaaccgttttaccgtatccaccggcacttccgtccccacacacagcatctctgccgctatgttccgcagctcctcgtagcgctccttgtcatattcggttccaccgtaggtaagtcccgcctgcgcaatgctctgcacgcgcatcgcaagctccatccactgatccatgcttcctccattccgcagacgccgtgcgtcgtgcatccgtgttatctctcctgtatttcctttccgctgagatgctcgatcgtaatctcgtatacgctcaccgcttttcccacgcgctccatctcctcctcgatcatcgcctcatccggataatattttgccgcctctgtgctgatttcttttgtctttcttctgattggttgaaacatgattgcctcctttttcccgtctctcttctaaaatgtcaatgtctgccggatgctgtatccatccttcttaaaatccgaaaacagcgcttcgatctttattatttttctcaagaccgatgaatttttcaccgccctcccacagataatcgataccattttttcatgtaggcatcctttaataattcgttatccgcattcactaatttcacaaacagacctgtcagtccatcatatttgtggaaatcgcctgcatcatataatatcacaaaatcattttgccacagaactttccgtttcacaattcgtatttggcaatcccacgcactttttccgatcttacaaccaaatagtaattttatattttatattgtatatacacgcaaaaacagacatgataccgattgcttatcggaacaccatgtctgcttttgaaaaacttccatccttctggaagccctttttatcttttctgaattttttccttaattctcggacttacaatctgaatcataattaccacaataaggataatgcctttgattgcgtcattgatgagagaatccatctttaacgccactataattttatcaatgactgtgtaggacatcgcaccaaagagaataccaagcatttttcctctgccgcctgacatgctgattccgccgagaaccactgccgcaatcgcatacatctcatagctgcttccggttgttgccgggtctgccgacgcattcatcgcaatccatacaaacgatgccagtccgacaagcgctcctgcaattacaaaaacagaaacctttaccttatcaacgtcaattcctgtcatgcgcgctgccttcgcattgcttccaaccgcatagatctgttttccgtattttgtttccgttgtcagatacacaaaaataattgtcactgcaatgaggaggattcccacgattggaaccgtaagcacttttccgtttcccatattatacattgcctgatacagcgtattcgcattcgccatgcggtaaacagaacttccgccgccgataaggttcttatcgatatgctggcaataatactgtgcaaatgagcggtaaataagcattgtcgcaagtgttgcaataaatgccggaatttttccatatccgaccagcataccgttgatcagaccgcacactgcgccaaaccctaccgcaaaaaggaacgtcaataggatgttatctgtcatgttaaatatcactaccgaaaaaccgcttacaagcgcaagcatggaacctacagaaaggtcgatatctccggtcaaacagatcagtcccatgccgaatccaatgattccaatgactgcagaatgccggaatatattcataaatccactcatcgtcaaaccgtgattggtaatcacatatacgattaaaatgataacataaacagcaatgtagctgtattcactcaggaatttcgttcgttttgatttctccttcattataaaacctcctctaactgtacagcatttgttgcataactcatcactgttgtttcatctatctggctatgcgcaagacttcctgcaattttcccgttataaaatacgatacagcggtctgcaactttttttatttccggtatctcaagtgtgttaagcagtatggtttttccttcggaagcaagcttcagaatcaaccggtagatttccgcttttgctccgatgtcaattccctgtgtaggattatccagaagcaggatatccgcatctgtgtcaagccatcttgccagaaataccttctgctggttgccaccgcttagcgacgtaataaaatccgcactatcggctgcttttatatttaatatatctttaaaattctgatattttttctcttcctgttttttagaaatacaaggtttctttttggaaagaacatgttccgccaggtacatattctccaaaatcgacatatcaggaacaaccgaattttctttcctgtttgccggaagcattgcaaccttgttcttcattgccgcctgaatcgaatgatgaggcacacaatttccatttacatacatatttccgccatatgcaggtgttgcaccgaacatgcactgaagaagttcactgctgcccgctccctgcagtcccgtcagcccgataatctctccctttttaacttcaaaactgacgtcacaaaatccttctccgctcagattctcaagttttaaaacagcttcgcctttttgtctcggttcataaatctcgccggaagaataattttctcccaccatcttctgtatgatggtatctgtatccgcctcgctgatttttccggaatcaataaattccccgttacggaaaatcgtatagctgtctgaaattctgaaaatttccggcattttatgagatataaagataaacgctgtcccgctttccttcagtcgctctataatatggaaaagatgttcgatctcactgttgttcaaagctgtcgtcggctcatcaagaatcagcaactttgccttaaaaaacaatgccttcgatatctccagaagctgcttctggcttgtcgtaagcccggacacctctatttccggatcaatttccacacccagttcctcgaaaagttccctcgactcttttatcattctctttgtatcgactttcccgaatttattggtatattctctgcaaagaaaaatattttcataaacctttaaatcattaaacaggttcaactcctgatgtacaaacgcaatccctgcgttttccgaagattttacggatatatttttcatttcttttccgtcaaacacaactgttccggcgtctttgtcatgtacacctgtgagaatattcataagcgtagattttccagctccattctctcccaaaagtgcatgaacctctcccgcttccacccgcagagaaacttctttcagcacctgtatgccattaaaggatttgcatattccgttcatctctaataaactcataaataactccattctaccgaaatgatcatcttttatcatgcatgttgtccaccatatcgggcagacaacatgcattggtttaccaaattagaatccttcgtactctgtcacattctcagatgtcacattttcacattcaatcacatgatcctgcggtaccgtttttccatcaagataatctaccatatcctgaattgctgtctgaatcatcgacggactatatgtaacagataccagacctccaaactgggctgtaagttctgtataattttcgccgcgaagcattccgtaaaattcatccagtccgccacaaccactgattaccggctgatttgcaagaaatgcctctttggttgtctcatcgattccaccgccgttgagcgcctcgataatacccattgcaagctcatcatcttccgcatagaaccactttgtatcagcgtttccagcatcactcatcaatgactcaaatgcggtcttggtatctgatctgctccagttcattgctcctgaatatgtgattgcactttccacctgctcttctgtccactttaaggaatcctcaatcgtagcgtcctcgaactctgcatttccaagcagatattctttaaatccctggtcacggagtgttgttaccgaagaggtatcgccctcatatacatatacctcatcccccggctgcattccgcaggatacgaaatatgctgccgcggcgacaccgattccttcattgtcgccttttacattcgatacagcgctcgatgcaacaccatcaatgatccggtcaaatgctacatatggtatttctgcatccacgatctgctggatcgccgactgcactgtgtcatcaattggctgaataacaatcgcgatatttttctcaccttttgagaggatatcctcaatatttctaatctgctctgaagcatccgctgaagtaatcagctcgcttgtgtatgttcctgctgcatttacttcctcgattttctcctttgcaaatgttgcaacagaacctgtccagccatggtcctccggtgctgtcaaaacatagatatgcgtgctatccccgttttcgctttctccggtgttctgtttttctgtagctgcctgtgatgtcgacgcgctttccgtcgcagcatctgatcctccgcatgctgttcctcccaataccattgctgttgtcattgccaatgccaaaattctctttctcatagttttttccttctttcttttatttattgaaacggtacttaccgtccaattacattggaaactgtctgatatactcttttgattttaaaagactctttaaaatctcttctctggagctctcaaacgctttgtcttctacctcaatacatacgtatccgtcatagccaatgtccgtaagcgcactcacaaactttccccaatttacatcccccaatcctgggagcttaggcgacataaacttcagtggataagccataacccctacctttgccagtttctccggatataactttatatccttaaaatgtacatgaaaaatcttatccttatattcatagatgggatggatgtagtccatcatctgccatacaaaatgcgacgggtcaaaattgattcccagatattcgctgtcaaggatctcaaaaatcttatcccagttctccggtgatgtcataagattctgtcccccaggccactggtcctcgccaaagagcatcggacagttttcaatggcgatcttcacctttcgttctttcgcatactccagaataggcggccagattttctctaccagctttaaattctcttccacgctttttgtctgatcccgcccgataaaagtcgtaaccatattgacgttcagcttcgcgctggcatcgatcacgctcttcagatgtcgaatattctcttcgcgtttttgttcgtccggatccatcgtgttcggataaaaagcaagagaagatatctctatttttcgctctttacagtagtttaagatgtactccgccttctgatcatcaagcgtctctgtatcaatatggcacacccccgcataccttctctctgtcttccctgcactaggccagcatgcgatctcgacacattcaaatccctgtgccgcagccgtatcgatcatttcttcaaaagaccatccatccagtatcgaacttacaaatccaagtttcatccgtgtatcctcctattgaatcatgattgtttttttctcttttgcagattccaggcttgcgaatattgctttcattgcattcagcacatcccttccgctcacttcaggttcatgattatttaccactgcttccacaaaagaatcaatgattccggacttcgtctgattatcgttggtttgaattttgtctatgtcgtatagaattttctcaccgccgcgtgtgatgactttaatagagtaaaccggatcatcatatattttcataattccttctgttccgtaaagaattgttgaattatcctcttccccgtaataagtccagcttgccgtcatggttccaaccactccgttctccatcttatagatgcagattgcattgtcatccacaccgatcagatttccctgcgcgtccttcttgtcaagcgttgttatatgcgctgttgtttcaatgactctcgaatcaagcagaaactgtatcagatccgtcttatgaaccccaaggtctgccattgctcccataacggaacgcgatttgtcaaaaaaccatgtgttcttcgcaccgtcaattccccatgtctccggaccgccatgtccgaatgtcgtcttaaaagtaattacgtctccgattactccctcagagattaactctttcgcctttacatgtgcttttgcaaatctctggttctgccctatcatcagatatttcccgttttcatccgcagcttttaccatgtccatgcattcctccagcgttactgccatcggtttctcacaaaggacatgctttccagcattcaacgccttgatcgtaacttttgcatgtgcgttatttgccacacagacactgacagcatccatctccttgtctgccagaagttcatcctccgtgctatatgccttgccgccaaattgcgctgccagttctgctgcccggtcagcattccagtcataatatccaacaatttctacatccggattttccaggtattccggaatatgtctaacctgtgcaatttttccacacccgattattccaaccttcatgttatctcctttcatattttctttcattctttcattctcttgaaacaaaagtaacatatttttttcagcaattcaatcattctatcgtcatttcaagcattttcagcgctttgtttctttattttcgtttattttgtcaataatcgccaaagtatttcttatatagctgaaaacttttcacattttgtttcattttatatttacaaaataaacaaaactggtgtatcattattatattgatacacaggaggctcacagagatatgaaaaaagataaaattacggtcgcagacatcgcaaaaaaagcaggggtctcccctgccactgtttcccgagtgttgcgtcatagagaacttgtaaaatccgaaaccatccagcaagtcgaaaatgccatgtccgcactgggatgtcttctcgaaaagggtactatagctgcggctaccgaacagcctcttattattttgaatgttccggaactcgataacgttttctacctgaaagtcatcgacggcgcccttgtatccgccaaggcacacggttatcgtctgctgatcaacgactccccgcttgaccggagttctatttactcttttatcaatctgttaaaacaggtacatgccgccggagtcattttattgaatcatgtctccaaggaacagctggatatgatccactctgtcgtaccgttagttcaatgcagcgaatataacgagcacgcggattacccttatgtcagcatagacgactatagtgccgcaacaagcgctgcagaatatattgtttcctgtaattgtaataaaatcgcaatgataaacggtcccatgtcctttaaatatgctgtgaagcgtcaggaaggttttcttgatacgctccgcaaaaaagatatttccgttcgtccggactggattgtcagcctgcctgaagtaaattaccagatggcatactccgcagtctgccgtctgttgaataatgaaattcgtccaaatgcttttttcgttatctcagacgtttttgccgccgctgtcattcgtgccgctaaacgctttgatcttcgtattccggaggatattattgtcgtcggatttgataacctggacatctccatcatgacctgtccgacgattaccactgtaaaccagccgagttttcagctgggctattcggcatgcgaacttcttcttgattccatcaaccatcctgatatgtttcccaaatctctgattctggatacagaacttatcatccgggaatccagcgcaaaaatttaacgcccggcagattgctctgccgggcgttccctgtaaatttcctaatcactgttcatgaattgcttcaaacactccgccgtccgcgaaatgcttcgccgacgcctcactccatccaccaaagtgcgcaatatccgtgagtgcaatgtcatccacgatccattttccgtctgccggcagttccgtgatgacgcgctcccccgatgtactgatataatcggaaaaaacatccggatccgacgggcggtagaagttctccgcaaacgtggtcgtcgcaccgcgcgcacccgaatccagcaccagcacattgtgatagagtgtcttcatattctctgtgatctcttccccgctctgtccctgactttcaaaatagtaccatgccgccagataattccagcgcgctccgccggacgtcttcgggttcggggtgatgacgcccacgtcctcccggagcagatcatcccagtccgcaatgttcttcggattgtccttgcgcaccagaaaaacaatcgtcgatgtgtacggggaactttcctgatcaaattcatcctcaaaaccatcctcaatcattcccgcatccgcaaccacctgcacatccccctccagtgccagcgtcaccacatccgcctccaggccgtttgccacctcaagtgcctgcttgccggaacctccgtgcgactggatcaccgtcacatcctgccctgcctgctccttccagtgttccgcaaacagtgcattgtacgattcatacagttccctgtgctttgaaccttccgttacatggtcagttcttactttgtctcgccgccctctaccacaagcgtatcctcgtagtcactgccgtaagtgtcagccagtgttgcctcgtaatctgcgtggaaaaaattctcctcgccgagtgccttgatctcctcattgatccagtctaatacggtcgtgttgcccttgctgactgccggcgcaattgtatctgtgcttccaagctccggtatacctacggtatagcccgggttctggagtgcaaatgcaatgacctctgtgttgtcatttgcccatgcaacaccgcttccgttctcaagcgctgtctttgctgccgcataggaatcatatttctgtaaggtcagatccggatagttctcggtcaggtaggtctctgctgttgtaccggaaatcacgatcaccggatcatccgctgtcagatcatccagactctcaaccactgcagaatccggagaaatcacaccgagggatacgttcatgtacgggagtgcaaaatcaacttcctccgcgcgctccggtgtcacggtaaagttagccagaatgacatcgacttttccggtctgtaaatactcaatacggcttgcagcctcggtggaaacgaagttcacatccacgccgagatcctctgccagacggtttgcaaagtagacatcatatccctgatactctccgttctcatccacatagccaaatggattcttgtcggaaaatacaccgatgttgattgtgccgctctccttgatctcgtctaaggtgcggtataccacatctgcggatgcatcgcctgcggatgcctgtgtatctgcggtaactcctgtctgcgcatcactgctgctctccgctgcatctgtattgccacagcctgccagcattgctccagttaatgtcagtgctgtaaacagtgccagtctcttcgttaatctttcttttttcataatattgtcctctctttctattccaaacttccatcgaagcttcagaatcaaccttttgtgccgctctctagtcgcggactgcctcaaattcaaatgtgtgcagaaactttttcgcacgctctgtcgtcggatgggtaaaaaattcatccggctttccttcttccacaatctctccctggtcaataaagaccacacggtctgcaaccgcccttgcaaaggacatctcgtgtgtgacgatcaccatagtgcttcctgccttagcaagctctaacatcgtatccagtacctcgcgcaccatctccggatcaagcgctgcggtcacctcatcgaacagcataatctcggggtgcatcatcagtgcacgcacgatcgcaacacgctgcttctgaccgccggaaagctgtctcggaaaactgtcacacttgtcgagaagccctactttttccagaagctgttttgcctcggaaacggcgtcctcttttgttctcttctgcaccttaagcggtgccaggatcacattttccaggatcgtcttgtgtggaaaaagctcgtagctctgaaataccatcccgaccttctgacggatcccggcgatattcttcgcctttccgtcgatggtctcgcctcgaagcgtaatgcttccctcctgaatcggctctaaggcgttgatacatcgaagcagtgtgctcttaccgcatccggatggtccgatgataaccacaacctctcctttgtggatggtcaggcttagatcctttaagatcttgtttccctcgtaggattttttgatatgttcaatttttaacaattcttctgcttctgccttcatatcagttactccatttcttttccagatgtcccgccagcatactgatcggccagcatgccaggaaatacagtacaaacacggttccgtacagtccgaacgccgcattcggcgatgccatacggtttgcctcgatgatctgctgtgtcacctttaacacctccaccacaccgatcatcatcacaaggcttgtcgtcttaatcatacgggtgaccaggttgatcgacagcgggatcagacgccgcagggtctgcgggataataatgtaaaaataaatctgacttctcgtcattccaagcgctgcaccactctcatactggtgcttcgggatactgattaacgcgccgcgcaccagatctcccatctctgcggttccccagaatgtaaatacgattaccgatgcaaactccgccgataaattccagccaaacatccgcgtcgttccgaaaaacacgagaaacagcagtaccatctgcggcatgatgcggacaatctccagatacactcttgtcactgcttttgtcaccggattcttccatgtcatgacgatgccgagcagaatgccgagcggaatactgatgaccacggcgatcaggctgatcttaagcgccacccacagaccgcccagaagccttatcatgttcttgcccttaaacaggacgctaattcccaaatccggcatagcgcagcctcctctctaacaatgttccaaggatggataccggaagtaaaataatcagataaaataccaccagtaagaacaggcactccgctgtcttatagtaaagtccgatcaggtctttggctgtaaacatcagatccatcaggctgattgctgaaaacacactcgtctcttttaacaggaagatcacattcgccacaaatgccggtacgctgatggataccgcctgcggcagaatgacatagaccactgcctgcttcttcgtcatgccaaggcttaacgcgctctccatctggatcggctcgatcgcctcgagtccgctgcggaacgcctccgccatatagctgcctcctaagagtgccagacccgccacgccgcagacatccgcggagatggaaagtcccaccttcggcagtccgaaatagataaaaaagagctgcaccagaagcggtgtgttgcggaacaattcgatatatatttttacaatctgtctcgccaccggtatcttataatgtacaatcagcgcacatataagaccaatgatgattgaaaatgcaattcccatccagccgatccggagtgtcagccacatggctttctgatacagcggcaggtattgcgagatgacttcccagttcacattttcacatcctatcttatttcttattattcctagctgttttatatgatataagaaatatactcctactttatatatatgtcaagtaggaaattaaataatttctttttgttctaaaaaagaaacagaatcattctgtgtcagagaatccttctgttttgttctgttactctatttctatattctatgcagttttaatattatgctttccggatgccgtcgttcatgcttcccatccggtatccgccgagatcgagtgtcacataggtaaaaccgatctccttgcatgccgcattgaccttctggtaaaaatcgtctgcaaacatttttgcaaaatcctccgtgccgatctcgatacgggcaatcgtgttcgttccgctctcgtgaatccgcacgcgcacctgatgaaatccggcatccagcagaagctgctccgcgcggtccaccatgccaaggcgctcctcggtgatctcctccccgtagacaaagcgggaagaaagacatgcaaacgactgcttattccatgtcggaagccccagcccgtgggagagttcgcggatcatgctcttgttcatccccgcctcgcgcagcggactaagcacggaaagctcggcaaccgccatcagtcccgggcggtaatcgccgttgtcgtccagattggacgcctccgccacgtaggggatgtcgtactcctttgcaatatcccagatctttgtgaaaagctccttcttgcagaggtagcagcggttggtcggattatgggaaaatccctcaatctgcaattcctccgactccaccacgatatgttttatgtgctccttctcacagaatgcttttgcctctcttaattctctctccggaaaggaacaggagcgagccgtcactgcgaccgccccatctcccagcacgtcatgtgccacttttaataagaatgtcgaatccacaccgccggaaaatgcaacaaccatcttccctttttcccggatcgactgttttaatgcttccatttgttccatcgtattctaaacccgctttcttccattttaattacacaaacggattgtaaaaacggcttccgttgctgaaggtaatcatcagtgccaccgcggaaaatgccgccgtcacaatcagcaccgcatagtctgccgccgccagcggctttcccatataccaggtgcgcttcttgtgctttccgaacccacggagctccatcgcattgctgaccacgtcgatgcggtccatgctggagaataccagcgggaaaatgatcgccgccacgttcttgatgcggtcgccgagcttcgccttgccagacatctcaattcccctcgcctcctgggcgtgcttgatttttgcaaaatcatcctgcacatccggaatataccggagcgcaatcgccacggagtaaccgatcttgtagctgacaccaacacggtttaaagaagcggccagttcgctcggattcgttgccacgataaacatgaacaccgctggaatgaccgtcaggtattttaccatcacgttgaactcataaaacagctgctcttttgtcaacgtgtaatgtccaaacagatgcactatcggcgtctccgttccgtaaatcttcgtcccctgtcccggagaaaagaagaaaatggcgatgagattgatcaccagaaaaaacatgatgaacttgaataccgtaccgacctgcttccacttcgtcttcgacatggcaaaataatcaggctgcacacaagcatgaccaagagcacccgcgtatcgtaggagatcatgctggtgatcgaccacaggaggaaaaacaaaagctttgtcaccccgctcagacggtgaatccatgtgtctttttcttcatatgataatacgcgcgacattatgcttcctcctctctttctgccgctctcatctgccgctcgtagccgataaagcgctccacgaactgtgtcggctctgcaatgccgcagcgcaccgccagatcgtagagagatgttttcttcaaataggcacgatccgccaccgcatcatccgtgagtaccgccgccggagcggtatctgccagaagcctgccgtcagcaatcacgaccgcgcggttcgtatactctaacatgagatgcatgtcatgtgtgatcatgatgatcgtaatgccgtactcctcattcagcttctttaaaaactccatgatctccgtataatgtctgtagtcctgtcccgccgtcggctcgtccaaaatcagcacctgcggatgcagcacgaggatcgaagcgatcgtcacgcgcttcttctgaccgaagcttaacgcggagaccggccagttgcggaactggtagaggccgcagatctttaaggttgcatagacccgctccttaatctcctcctcgggcacgccgcgcaccgcaagtcccagcgccacctcatcatagatcatcggtttgctgatcatctgattcggattctgcatgacaagtccgatcttctcgccgcgctccttgatcgaccagtctgcaatgtcctcgccgccaaacagaatccgcccctgaccgggctttaaaaagccgcagatgagattcgagagcgtcgactttccggcaccgttcttgccaacaatcgccagcatctcgcccttttgtacctgcatatggatgtcggttagaatcggcgttcttccgtcataggaaaaagcaagattctccaccgagaggatgacgtcatcccccggttttttctccggcagtgcaaccttctcgttccagcggcacagcgcctccttataaccggacaattccatcgtctccacatgcgccggatgcgtctcgggacggatctcgcatcccgcatgcttaagcgccgtgatgtagagtggctcgcggattccctcctccgccagtacattggctgccagaagttcatccggcgtcgtatccgccacgatctttccctcaccgacgacgatgatgcggtccacatcccggtacagtgcatcttccagacgatgctcaataatcaggatcgttgccccttttgccttctgcagctcatcgatcaaagcgatcgtgcgctttcccgtcgccgggtccagattggcaagcggctcgtcaaacaacaggatatccacatcacagaccagcacgcccgccatggatacgcgctgcttctgtccaccagacaatgctcctggtgcatgatcgagcaggtcttttacatccacagcgtccgccgctttgtccacgcgcccgcgcatctcgtgatattccactctgtcattctccagcgcaaatgcgatatcctccgccaccgtaagcccgatgaactgaccgtccgtgtcctgcaaaaccgtacccacagacttcgacagtccaaaaataccaagctttgcgggatcctcgcccttaatgcggtaagtccccgtgatgtctccggcataggaaaacggcacaagcccgttgatgcagtgcgctaatgtcgactttccggaaccggacggtccgacgatcagtaccttctcccccggataaattgcgagattgatgtcctttagcgtcggttccttctgggaacgatatttaaaagaaaaattctgaaattctatgatcggttccattccgaaatcctcgtcttcctctcttgtggtacttcccgactattatacttgataataattccaaatggaagaaaaagtgcgcggaaccggtcacattttgcaccccgtctccgcgcactctgtctgcttctgtctttctgctgccggaatccgcctagtcctccttggagagactggacgattttgctccgatcttggagtatcctgctgcgatcaaagtaccaagaataccaataataatcacgtttccaaggcatgcccatgcaccctgtgcaaataccttgttggcaggctctgcgtagatcacaatgtcaagtaccggcgcaacgatcacccatgcagcgaggttggcaacaacctgcacaacgttgaacagcacgatctgtttcctctcgaatccgccgtccttgatcgcatattttgcagcgaaaagtccgaccagaatgccgaataccgcgtccggaaatacccagctccaccatacgcttccataaaacagcgcatcaccgattgcatgtcccagaagaccgacaataccgccgactaccggaccgaatacggctgcaaggaatgcgagcaatgccgctctcggctgtaaggcggtgttcgggataattcccagagggatctgtacctctgtcagcgcaacgaacaacgctgttccaataccggttgcaacaacttccttaataccaaacttcattttcataacaaagtcctcctctcatttgtatctgcactgtagtataacacacacttttccgatttaccagatagaatttattcctgccatgtgtttctaccagagcttcagcacgccgattgccgtcttcatgaacttgtacttcaccgtctcgagttctcccgccgccgcttttaactccctgcggatctcaatatgctgcggacagtgctgctcgcatttgccgcagcccacacactgcgaggcgctcgccggattcttgcggaatgccgtacactgcaggtaatccctgcggccggacttttttccttcggagtacatcgcattgtagcagcggaatgtcccggggatatccaccccgcgtgggcacggcatacagtaaccgcagccggtgcatcccaccttgacgtgctttgtgatctcctgccgcaccgcttccaccagcgcgcgatctgactccgtcatgcacccgacgccgtattccgaagctgtgcgcacattctgttcgaccatctccatggaattcatgccggaaagcacgcaggtcacctccggctggtcgtacagccacttgagtgccaattctgccggggtgcggtgctcctcatcctgtgcgaacagctccttcgccgactccggcagcagattgaccagcctgccgccgcgcagcggctccataataatcactggaatccccctcgcgtgcgcgtagcgcagcccctccacgcccgcctgcgaatgttcgtccatataattatactggatctggcagaaatcccagtcataggcgtcgatcagctgcatgaacatatccgatctgccgtgataggaaaatccgatgttgcggatctctccggacgcctttttctcccggatccagtcctccatgccaagcttttttaacttttcccaggtgggaagatccgtcagcatatgcatcagatagtaatcaatataatctgtctgtaagcggcgcagctcctcctcgaacatcttctgggcgccctccaccgacttgatcaggtagtgcggcagcttggttgccaggtagatgcgttccctgcaatgattgcgcgcgaggatctccccgaccgccgcctcatttccggcatagacatatgcggtatcgagatagttcacaccggcatctatcgccgccatgacctccttttccgccttatcgatatcggcatgcccgccctccttggtaaaacgcatacacccgtagccgagcaccgaaatctcatttccgtttttatccttgcgatactgcatgatcatccgatctcctccaactgctgcagccagacagccgcgcacgcgtccgacggcatccgcagatccccgcgcggagagaccgccacactaccgactttcggtccgtccggcagacaggaacgcttgaattgctgtgcaaaaaagcgccggtaaaaggttttcagccattttaagatcgtctcatcgtcgtagacgccgtcaaacgccacttttgcgagacggtacacctttttcggtgcaaatccaagacgcagcatgtggtacaggtaaaaatcatgaagctcgtacggtcccacaagatcttccgtcttctgcgagatctttccgtcctccggcggcagaagctccggagataccggcgtgtccagcacatccgtcaataccgcgccaagcttctcatccccgcaggtatccgcgtagtagcgcaccaggtggcgcaccagcgtcttcggaacggaggcattgaccgcatacatggacatatggtcgccgttatatgtcgcccagccgagtgcaagctccgagagatcgccggttccgatgaccatgccgccctctttgttggcaatgtccatcagaatctgcgtccgctctcttgcctggccgttctcataggtcacatcatgaacggccggatcctgcccgatatcacggaaatgcacattcaccgcttccttgatgtcgacttccgtaaagtccgcgccgaggcaccggatcagggacaccgcgttgtcataggtccggtccgtcgtcccgaagcccggcatcgtgactgccttgatccggtcgtgcggcatgccgagcagatcgaacgcgcgcacggtgacaagcagcgccagtgtggaatccagaccgcccgaaatgcccacaaccgccgtcttacagtgcgtatgctccagacgcttttttaatcccgctgcctgaatggcaaggatctcatcacagcgtctgatacggtccgcctcgtttcccggcacaaacggcatcgggtcgatgaagcgggtcagagccgtctcctccgtttcaagagaaaaacgcacctccacatagctgtcatccgccatctcaaacgtcgtcatccggcggcgctccgcctcgatccgcttgacatcgatctccgtgcagatcacaccgcttccgaaccgctccgattcctttagaatatgaccgttctcggcaatcacattgtgtccggagtagacgacgtcctgcgtggactccccgtctcccgcactcgcatagatatagccgcacagaagtctcgccgactgtccgtttaccagctcccgccggtagatgtcctttccggtggtctcatctgatgcagacagattcacaagcagcgtcgcaccatttctggcatgacggatactcggcggctccggcgtccacaaatcctcgcagagctccgcgccgatctttaattccggcagagacgtacacacaaataaaagcctcgtccccatcggcacgcactctccctcgaaatcgacctcgaccggatctgccattcctctggcaaaatgtcttgcctcgtaaaattcattgtagttcggaagataggttttgggcacaaacccgagcacttccccgcggcagagcaccgctgccacattataaagttttccgttgtacgcaagcggtagaccgacaaaaaggatggcgtccacctctgctgtctcctccgcgatcgttccgagcgcccgcttcgcctgctctaaaagatattcctgcaaaaacagatcactgcaggtatatcccgtgatgacaagctccggcagcacgatcaccttcgcgcctgccgccgccgcttcccggattccttccacgatcacgccggcgttgtattttgtgtccgccacacggatcttcggtgtgacggcggcaacttttacaaatccatctctcattttctcatttcctttaactcgtcgatgtcaaaatggtacgctttgttacagaactggcattttacctcaatcgactctccgtcgcttacgatgtcgtccagatcctttctgctcagtgtcgcaatcgcacgggagacgcgctccttggagcagtcgcactggaatgcggcatccaccgtatcgttgatctcaagcccgaactcgccgagaatcagctccaagatctcctccggtgtcttcccatcttccagcatctccgtgacggaggcaatctccgtgatcttcttctcgagacgatccaccacgtcgtccggtgtaaacggcatcagctggatgataaatcctcccgcctgtctgaccgaccggtccggattcacgagaacaccgagtcctaccgcggacggcacctgctcggaggtggcaaaatagtacgtcagatcctccgcaatctcaccggtctgcagcgcgatctgtcccacgtacggctcctttaatcccatgtccttgatgacgctcatcacgccaagccccagcgcaccgccgacgtccagctttccctgtgcatttaacggcagttccacatccggaacattcgggaatcccttgacatgtccgtttgcatccgcggtcaccgtaaagcccttcgccgggccgccgcactggatctgtatcgtcagaagatccttctcccccttcatcatcgttcccatcatcgccgcaccggagagaagtctgccgagcgctgccgtaatcaccgggctggtgtcatgatccactctcgcctcctccaccagatggcgtgatgtgatcgcaaatgcgcggatacttccctccgctgcggtagctcttacaatataatctctatcctgactcattttgttctccttttctattgttgctgtatttcagatttgctacatcttcttttcctgctccgttttcatgcacggtatcttttctttctgctccgttttcatatactgtatctttttgtactcagttcggattcgttgttcctgcatcttctcaaagccttctacctgcgtgggcgcgccaccacatagatccgctccgaatcctccttgaccggctcctttgtgaacgcgtcgtaggctgccagcaattccattcccgcatccgcaagcagtctgtcaatcgtctttaaatcataggcccgctgataatgcacttcctcaaaccggcggtaggttgcaccgtcctcgcggatataaagcgtcagatcgtattcatttacggcactctcctcatcgaaataattctcccagatgaagctgccctcctcgcggttttccgcaatcgtcgtctctcccagaagatcccggtacttgtataccgtattcaggtcaaaaataaagatgccatcctcctccagatactcgtgcacacgcgaaaacacctcgcgcagatccgcttcctccaaaatataattcatggaatcgcagaccgacaccaccgcgcacacgcttccgtacagttccagttcacgcatatcctcgagcagatagagaattcccccattgggcagctcgtccggttcatccggctcgcccagttctgcatattcttccggctcatcggtttcgtcagcttcgtcccatgcttctgccgcactccacgcatccgcctcatactctgcctcgcgtgcgatctcaagcatctcctcggaattgtccacgccgatcatatcgtaccctgccgccgccagcagcctggtcatttttccggtgccgcaacccagttccgcaaccgttccgctgcagatgccgtattcccggagcagccccataagataggaaccccattcctcatagggaacattatccataaacagatcatacactctcgcaaagctctcgtatgcacccatatcgttctcactttctcttccgccagcatgcggaacatttctatgtaatactaccaagtttccaatgtgaaatcaaggtttgccgacagattcccccgcacaaatcttcttgattatttttccggtaaaccgtatacttattccataaaatgctgttttttccgatgtttctggaaacacagcaaaatacagcaaaggatcttacacctatgcccgatcagtttgaacactatattaccaaaaatataaaggcattctacaagcgcagactgctgacaccgatcctgtatctgatttttcttctggtactgtggttcgttctctcgctgtcagcgccgctttttccggacacgctcgatgccccggataccctcgagagcacctacagacggcatgaagaatacatatccgccaccttatccgatctgaagttcaccggttacacccagtcctttctagggcacatcagcggttactactattacacgatgcggaatgacgagtgcatcatcgtgctgctctccccgaataccagtgaacagggacttccggagattccgcaggtgtccgtccgtgccaagattcttcacggttccgagaattttgatgagctgttaaatcatctcgcttcggatctgaactggaccgaaaacggcattcacaacaaagtctcccagtatgtactgagtgagcctgattacaatctgctcggaaacacgctgctctacgtcgtattttttgcgaccggcagctatgccctgatctgcattgtatttttcatcctctacatctgctttccaattctctcgcccgcgtgccaggatctcgcgctgttcggcaatccgaaaaagcttttggagcaggcagaggatgaacttgcgacgctgccgcagcttgcaacggaggatatgtttatcacagaacatttcttcatcgagacctcggtgtacggcaatgccattgtaccgatcgatgagatcatctggatctacaaatactcgacgctccacaagtttttctggtaccacttcagcatctcctacacgctgcatatcagtgcgaaccggcatctctacatccagtgcccgaagaacatcaagtcggacatcgacggtatcatagattacctcgccgaggcgaaccacaatattttagtcggattctccgaagcgaaccgtctgaaggtgcaggagatccagggaacgccgatgcattttgaaaaatttattgccatcctgaaaaagcgcgtctaaatcctgcgccaacacagaacggatcttttgcaatcagctctgagtgtcctttgagcgacaggtaatagttggagaagtacatcttacagatttcagatggaaatgcatatggaagattctttgtgaaaaaatgagagcatttcttcctgacggatatttgcatcggattccgtgtctcttccacgtttggacaatccaacgggaacatgtccgacacgccaaagacaatgggcggactttttagccgccctaactgtactccctcatagacaatataaaaccgcgcgaaccgaaactcgttgccatctgctattaaaaacaaggcagatggcaattcaaacatcggcttcgcgcggttatgtcttattgcgggagtacaggtaagggcggcacaaaagtcctacaaattgtcttcggagtgcggacatgacccgtggattgttccaaacttggaaagacacggatcatcgcggatgcaaatatccggctggttagaaatgccgcatttttgaacagaattttcatatgcattccatctgaaattgaaagatgtaatctttttatatattacctatcactcaaaggacactctgtgctgattgcaacaattcccctctgatgctagcggcaggaggtactgatcgactcaatcgccacagcaccgcctcttaccacttcgattctcttgaattttgagcggagcagggcaatcagttcgttgttgcgccgctctgtcagcttacattccagcagcacgctgtcgttcccgacgtccgatacctccacatggaacacctgcgctatctggaacacctcaagcttttccgccgcattgatgtctaataccttcgcaaacagaatctctttcatatggatcggcacatcggtgagatcaatgaccttgatgacctctaccatacggtttagctgctttttgatctgctcaaaggtaatgtcgtcactcgtcacgcagatcgtcatgcgggaaacggtctcgtcctccgtcgtgccgacggtcagactctgtaagttatacgatttgccggaaaacagaccggacaccttagccagaacaccgacctgattttccacatataatgcaatccagcgattcttcatagtaagtctccattcctatttcaagatcatttcactcatcggattcccgctcttcaccatcggaagcacgatctcatcggtggcgatcataaattcgatgatggtcggcgcctctttatatgtgcgcgcctcatctaacgccgcctggatatcctcctcgcgctccacacggattccgtgtgccccgtagctttttgcaagtgcgataaaatccggcgtgtacggcgggcaggatgcgttcggtcccttgcagttcgccgggcatccctttcttctgcgcagacaggttgcctcgtagcgcttgccgtagaataactgctgcatctgccgtaccattcccagataataattgttaaacacgcagatgatgaccggcgcctcctgcacgaccgccgtcgccatctcctgaatgttcatctgcagaccgccgtccccggaaaagcagaccacttccttgtccggattgccgatctttgcaccgattgccgccggaagcccgaatcccatcgtgccaagtcctcccgaggtaatcagctgatgccaggaatccagttccagatactgtgttgcccacatctgatgctgtcccacatccgtcacatagaccgcctctccgaacgtccggttcacatgctcaaaaatcatctgcggtgtcatgccgtgatccctgcgcatctcaagcggatttttctcatcccacccggcaatctgcgcctgccatgctgcggtgtctttggactccgcccactcgagcagcttctctaacgccagattggcatcggaaacaatcggaacatccacgaccacgtttcgggagatcgccgccgtatccacgtcgatatgtacgatcttcgccttcggcgcaaactcgtttaaatcgccggtgatgcggtcgttgaatctggtaccgatggaaaacagcacgtcacatttgctgactgccatatttgcggcatattttccgtgcataccgctgttccccacatagagcggatgcccggtcgggattgctccttttcccatgatcgtcgtcacaaccggaatctgcattttttccgcaaactgaagcagcttgtcgttggcatgtgcaatgttaatgcctccgcccgccagtataagcggcttcttcgccccgcgcagcagcttataagcttttttcagctgtcccacatgcacgctctcattcggtttgtaaccgcgaatctgcacactggaaggatactctgcaggtcctggcgccgtctggatgtccttcgggatatcgatgagcaccggtccgggcttccccgtggaggcaatgtagaacgccatcttgatgatgcgccccagatcctctcttttccgcaccgtcacgccgtacttggtgatgctccgcgtcatgcccacaatatctacctcctgaaacgcatcgtttccaatgagggataacggcacctgtccggtaaaacagaccagggggatgctgtcatagtgcgcgtctgcaagccccgtcatgatattggtggctcccggtccactcgtgaccagacacactcccacttttcccgtcgaccgggcatatccttccgcctcatggatcagcccctgctcatgtctgggtaagacgacttcgataccatcctgcttatatagttcatcaaaaagatccgtcaccgttccgcccggataaccgaacagggtggtaacgccttcttcctgcaaagctttcacaaataactttctgcctgtaatatccatgccgtcctccttaccttctctctgccgtccgtttcctgcagaaaggattattgtaaaaaactatagcccatctttttcacaaatgcaatcctatccaaagataaatcaagaatattaaaatacatcaagaacctttaccctatcaatcctactgtcttcaaaataaagatccatccggtcagggtaaacgctgccagaagcgttgtcatcacgatcacgctcgcggtgagtacaccgtcattgtccatgttcttcgccatgatatagcagctcggcgttgtcggagatgccagcataatcagaattgcgatcatctgctccccgtgaaatcccatccacgcagcaaccggcagaaaaatgagcggctggatgaccagcttgatcatggatgctgcaatcgtcgggcggatcttcgccagtgcttttcttccctcaaatcctgctccgatcgtgatgagtgccagaggcgttgccatctgtgccacgctgttcaccgtcttattcactatcaccggaaaatcgatgccaagaagtcccacgataagtccggtcaagattcccagaatgatcggattctttgcgatgttgatacaggcatccttaatcttctgcttcggatccacatccccggaatgtgccccttcaaacgtcagcacaatcacggaaaaaatattgtagagcggcactgcactcacgatcatgagcggtcccatcgccgagcttccgtacatgttctggatgaatgccagtcccatcaccgccgcactgctgcggaatgatgcctgcacaaaagctccccgcatgctctgatccttcaaaaacagcttcacaccaccccagatgatccagaagcacgccgtgctcacgagcgcgcagaacagcacataccggatgtcaaagaccgcccggatatctacgccggaaatatcgcggaacagcataaacggcagtgtcaccttaaagttgaaccggtttgccaccgtgacaaaattgtcgtttagcatcccgatctgttttaggatataaccgatcaccatgactaaaaagatcggaaatgttgcatccacactgtaaataaaattctccatctctacgccatcccgcctattttaccctctcgtaccggtaaaaataatactccagatcaaagtacgtctgctcctcgctatccgccgtgatcttccactccggtctctcatccagattcgggaaatacgcatctgcatcgtacgcatagtcaattttcgtgatgtgcgccacatcgcactcatccagaagctgtctgtagatcgtctctccgccgatcacatagatatcctcactgtcatatttttttaattcttcatgaagctcatccatgtcatgaacgacaaccgcacccggaaccttataggtatgatcgtgtgtcagcacgatattggtgcggttcttaagcggaagcccgttcggaaaactctccagcgtttttcttcccatgaccaccaccttgccggtcgtcgtctcacggaaaaacttctgatccgccggaattctcaccagtaactcatttttattgccgattgcccaattttgatccactgctgctattaaattcattttttacgcctttctattcgtgcttacaccgcgatcgggatatttttgatctgcgatcccgtcacgtaatcctcgatcgtgatatcctttgtcgtgaactggtaaaaatctttgacatccggattgagggtaaacttcggtgccggatgctgctctctcttgatcagttccctgataatcggcacatgccggtcataaatatgcgcatccgcgatgacatgtaccagttccccgaccttcatatcgcatacctgcgccagcatatgcatcagcaccgcatactggcagacgttccagttgttggcggcaagcacatcctgcgagcgctggtttaggatcgcgttgagtgtcagcttctcatctcccggctgatgcgtcacattgaacgtcatactgtatgcgcacggatatagattcatctcatgcagatccgcatgtacatagatgtttgtcatgatgcgccggctgaacggattattcttcagatcgtagatcacgcggtcaacctgatccatcatgccttccttgtactggtgcttcacgccgagctggtaaccgtatgcttttccgatggagccgtccgcgtccgcccactcatcccagaccgtgctgtttaagtcatgaatgttattggacttgcgctgccagatccagagcatctcctccgtgcaggtcctgatcgccgtcttgcggagcgtgatcgcagggaactcttttgagagatcatagcggttcaccacaccgaatttcttgatcgtataggcgctcgtcccatcctcccaatgtggtcttactttttccccctccgtgctggttccgttttccagtatatccttacacatatccacaaaaatcttatctgcgagactcattccgttcctcccgtttttcttccattctattctgctaattcttaattgtactcaattttccgtgaaatgacaaggtgcatttctgttgcatttttcccgcaaatgggttatattatttcttggaattttactttattttgcagagaataaagattgaacacataaaggagacagattatgagtcaggctaaagtagaccgctataaagaagagaaaaagaaccgcaagaagactatggcaaaggagaagcgcctgcatctgctcgctgttgtctgcggctggctggttgtcatcgcgctcgcaggctgggctggtgtgtccggttaccgcatctatgagagcaagaagccggttgagaccatttacgccaatgtcgatgccatcaccgattacatgaattccttaagcacagaagaataacgcaaaagaacccggggcgacttttccgcacccgggtatttttctgccatcctgcaatttttctatgtacgctcttctactctcccgtctctgcgccggagagttccgccttcgccagtgcattctcaatcgcgttcaacaataccactgatgtatactggtaatccgcattgtatgtaattccttccgtggtctgtttttccaccacctgatccgcaatgttttccaatgccggctccatcagcggatacattgtctccaccgtctcatcaagattgaccatggagacggactgaatccggttttcatccacaatcacctgcatatccaccgcatgctctccaaactggatcgatgacgtgtacactcccgccacatacctcattgtctctaccgactctccgtcctcttttccgggcaggaacatgaacagcagtaaaaaaatcagcagaattccaagtcctgcgaaaatcagtgtataaatcagttctttcatatgaagaaccacgatctttgtctttgcactcatcttaagcctccgcatactgattattacattatatgtggtgtactctttcccatgactgctttactctcaaaaacgctttaaaatcacaaattgttcaagtttttcaaaaaatataaaaaaaggcgttgacaaattttcattcacgctgtatgatatcaaatgtgtccggcagacataaccggcacaacaacttatgcgcgagtggctcagttggtggagcacgaccttgccaaggtcggggccgcgggttcgagtcccgtctcgcgctctcttttaacaaaaaggacatccgatggatgtccttttttgttaaatcgagtcctgccggaccaggtcgttcgaggtctacgctccgctccggtcgttgcctaacagcgtccaccggacgctggcttcttcgctacgcttcggtcggcgctctgctattgaaagccttggcaatttctggttaattaaccattggtcaaaaaatttttctcttattcaaactcattatgccccaggttatacttaacttattatagttaagtcttagttggatatggggcatatttctatatcaattacactatttattttgacctactgaatggacgttgccaatctgttgccacgagattattatagtttggattaggatgaaatgcaacagattctttaaaattagcactgttcaatatattctctcaaatacttaaacggaaatggaagaaccgtatattgactattacgcacaaattctactgccatcaacggaagagcctcctcatattcaagttcttctcccaaagaaatcaccttacgcatacaacaagcatttggatatgctaatctcttactcttagcccccacataatatacaaatgtacgtccatctaagtagtctttctcattgtattcgtacttgatgtttaagagatttccaatttggtaagtcgcttcaaattccccttttctcagctcgccatcaatccagactccatacttttcatgtaaaaacctattgaattttgatgcaatccctgtgcgcatatttaaaatctttttcattgctttcttggtaatcatttctgtttctgcagccaccttacttttccattcagaaatgcattcccttgaatcaatattatctttttcaaaatcatctattgcttccaataataattcttttgaaactctttcttttgcatccgtttccataagtgtattcattaatgctgatatattaggcaatgtcttttcgcgtgttaacaatatggcatgaatattatcaatatccgaatacattaatccttctaccggattctgtgcaccacgatgtttgtcttctacaaaatcatatgcataacaaatcttgttccactcttctgcttcatcttgattactatcacaaaatgtatcaaatttcatttcaccattgcaatcaatttccaaacgataatattggaaataattgagtgcctttttattaacatgatttatatgcgctgcattttcaccgtattttgtttttatcttctttctaagaacaaaggtccaatcttttccagaatcaagtctttcccaatcaaaaattgaaatcatgcgttctcttacatcaccttttattataagttcctgaacaatcttctttatatctggagaacttccctttgtatttgtaaaatgctcggcctcttctgttatatgctgtacaatatatccttttaagttatcactgtgtagatcatgcatctcattttcagcataatattcaccatcatgaatgattctgatattatatgcttcttccgaaagatttcctaccgctgcctttacatgataatacttctccaactcctcttggagctttgctacaatatcctttgatacttcagagttattttcatctacaattacaacaccctttttctgtaacatttcaccatattcaaactctgatattcccctcttttccaaattggagatatcaaattcttgtgcatcttccctctccacaatgtctatggacatatatttagaaagattatcattcacatctcttaaaaactgctccattacgcccatcttacttttcctaaaatgtgcaatatcagatatatcaaaattatctactctaaagtgattatgcggcaaggaaccttccttgtatgtaatgacattggtatctgtctttaatttttttctaaactcaccagtctttgaatctattacatacaatccgttactttctcgatcatatctcttgaaagttttatgttccaaattgagatacatccctggatcaataacaatctccaagaatctgataaaattcaccttacctgttaatttatctttatgtctccatgatgggtcatgatagaaaagcttacctgtgagattattatacataaaagcctcatgcttaggcgttctcattgaatttatcaggagttgtgcaagtaatctgttttcaaaataaaaacatttattgcactgctcgctatcaaacaaatcaatcttttggatttttacatcctcatactctttcataatactttctttaaattgcttttctgtcacctcacccttacggaacagcaccaatgcagttgcgccaaaggtccactgaactgctgccgccttaaattcatatactgccgaatctaagatattgtatttgtaataatccttattagacttctcgaccctaaaaatatcaaagtcagcatcaatattttctatattgtaggtaacattaattctgttagttaacattttcgaaatcctccttacaaatcatatgtaaattttcataacaaactgtaccatcttctcttataagcatcggaatctccaccaagcactgatccactatggcactcggcttgtaatttttatctgatacaacatttatgatataaacccgtttagcccctatagcctccaactttctcaatatatcttttctgatttcgtctctatcctgcacatatgtaaacttccaattcttaaaatcaacatacacatcatcagatagcttataatcgaagaattcaaaatattccggcactgttattggtgataattcaattcccaattctcttttcaatataaacttaccagccacttcgcccaatgcacctttataaatattatgaaacaacactggactaagaagatattcattcatttcaaatttcaatgcatatcccatttcttcaaaatgagctttcattccgggatatctaagtatcgcctgcaaaccggattccttttcactcatttcataaatagcaacttcatcagaattcccctttattttagctcttttactgtttttaaatgccaccttgtcgtttccaaaatctatagtaacatcattgaaatctgaatactgtgagtaaatatactggttccgcttttctccacttgtaatataaagtttttgaagatattcattattctgccagtcatatgtacttgccgtcggatactgtaataccaacgaccttaactgttcccacaactgcatactttcaatagtccaatcctttgccaacattcttcgaatcgtccaaagaccaaccgaggatatcttttccgccttattaagcataaggttttcgtccggaagataatcctttccaattgtctctcgcatagatacaattgctttcatttcaggtgataatatacgtttatttatttcaccaacatacaatttctctaacagttccgactcaacaaacaagtatatattaggactctttacaaatgttctacacatacgcccaactgcttgtaaaaccattcggctagcttgcacaactacactctttaacttatacaacttgtttaaagtgaattggtcacttcctgtataagaacgaaacgcaagctttaacatttggtccttttcagaataattcatttcaccgttctcgtataattcctcaatttgaaacaacatctgcaacaaatcatgagatgttattgtctcatcctgatatgtatttactgtcatattagttatatttcccagatacaatgcatcgaaatccttatataagaatctcttgtcaccttcggtaaactctcccagttgaacaacttttttacctttcagaatcttatattgtaaattctgtccagcacctatagtctgataagatgacataacaaatatcttttctccacatgacaatcgctgctgcaattcttccttatcttgttcaaaattgtcgcttttcaagaaacaaacactactattactctgctgtgtctccatctgagagtattcaaacaactgctgcagaacgccttcatccatgccgggattgttctttttcggcaatgccattcccaagtacaacattgattgaatatcttcattcctattaaaaatacacattgattgaagtacattgcagtatcttattatctgatattcgttatctgttatattggtgataatgtttgaagcataacgtgcaaattctgcatccataaatgttttgcaataatcttctgcattgaatccttgtatattactgctgattacttccccatgtacatttatctcgccatctgcataagcgctccatcttttttctaatgcagttcttgttttgtcctttaaataacccggcgtcttatgaaacctgtcttttaaccgctccttcaaatatctcaaatcataatttccaacaactgtatcaacttcagcagttgccgatatcccaaacacagttgcttttcctgcaaggtataacatgattttttcaggagtatcatataccttaacaaatttaagatttgtattgtcatgatgagaatcattatcctcaaattcataatactccatgccaacttgatagaagcttctatcctccaatatcagttcacgattatttctaatcatttggcaagtttcacccatcaacaaatctctttgcttattagttaattctaatctttttaggattgtactaatagcattctccaaattcatcgcatccatgataccgcttctggagctatttataatttccatgtaatttcttgcccattctatagaaaataacctaaaatgcaaaagaaatacattaatctcacgcaataaactatataacacaatatccttctctttgtttctgttcttgaaaaaatcatctttcccctcaaagaaaacatcaatacgattgtcttctttatttaaggatgagcggatatactgtgccccttcttttaaaaccgtatggaatgaaccatcattaaacaagaaaatctgtctctgatccactaaatcttctttggtttttatacttaaccttacatgataattctctgcaatttctcttgcttcatccattagtgttgtaaatgtatttctattccctaatttttcaacctcatccatagcttgtctcatactggaagaaaaatcgtttggattcaaagtacgatatatctgacgaaacaactgtatatagtcttcctgcattgccaatgacttatcaatcagctcactttgtatagtatccttcgttgcatcaaattcatcaataacaattactgcgttttctattaaatccgaattcaaaaactcataactggaatcaataagaatagaatttctcttcataaacttactgacactcattaatattattttgtaatcgtctgtaaatactgcaggatataattgcccaatccatttatatttagcatcagttctaatagcattttttcgctgtgtctttgtttgaaatctattctttaaatgtttagtaatttcatatcgaagctgcctgtccccttctgttattctgtcagccaattcttttatatattccttatcggcatatcttttttccacagcattacgataaagggaaacatccttgcataatttaagatacgcatccgttttcatttcctccggcacttcaatctcaagaattttttctacaacctcatcaaaattagagcgtaatctcaatatattacgcttataaagctcctcactcccatatgccgccctcaatgcatcttctggtaaattcttatttaaagttgtcaggtaaatgattttggtatcatcaccaattgaatccgcatattctttcattgcccgtgccgaatcataagtttttccattgcccgttggtaattcgcacatatacaaaccatgttcatgttgttgcataacatctaataagtaatctttcaacaccaaacctccttgtggttgcttatttcttgcatgattggtaacagtaaaattatatataattttatcatagaacggaaaaagaattgccgcatatttgcgtcaattctttttagaatatatttccatattttgttttatcaaatcagtcatagcattcctaacactctgtggttctaatacctctacatattgtaatcctaataaccatccaagcaagataacagacgcaactgcattaaaagtaactaacaacataccctctgtgtattccgaaattgtaatcctcttaccaaattgatctataaaaggaccaactaacgtatccggaattctcacagttattacctgttcttttcctgaaaacatacccatccgtcttgaaacatatgtattagcattaaaaatacggaactggcttttaccagctcttggtatatcggacaacttgatattatcaagtttatccactctataatttctttcacttaatacaccatctttttcttttacatcatatccatacaaataatacctatcatttgcccatattaaagcccaggggttcatgttatatcgtctatccgacttttttaccaacttcttatttctatcccacaccatataatcaaaacttatctgaacccccttagatagagcttcctgaatcaaatttacattatagagaattttcttattctctgcttttgcaatattaatccctaacacgcttctatccagttcttccgcatcatacagactcatagtagatttcaatttatcaatcattttggtggcaatacttttctcaatgaaattagacgcattaacggaatcaataataagtttcatctcttccttttccaaaagtctgtttccaatgaaataacgagcattccttccacgaccggaaattacatctacccctaattcatttcttaattgttttatatatcgcagaatactgtcttcactacagtaataaccttctgcatccatgtgaaccagaatatcttgcatagaaatctgatgttgttcgtctgtatatgctgtcagaatcttatataatgccaatactctgtttttttcgaaatcactcacaatttacctctttcttttattcaacaagatcaatcttatgtctttcacaccattgccttgctattttttcataagcttcatcacgatattggtaccactgtttctccagattcaagtcatacaatttatccttaaatcttctaaaagcgcctcttccttggattgcccctgccaatacattctgattctttccctccggaagctcgtatataaactcttccattattcgatactcgttgatatcgtattgtcccggtaacggtatataatcctcaacaaatccctctttgatatcttcaaaaagttccggattgtcctcaccatccaccattccatcaaacaacatcagaactttttcgttttgggtatcataataatattctgtttccataccggcaaattccattgcctcgattatgtcttctaattttactttcatcttttatccttatttcatgttcttttttaatttgttccctagcccgaggaacatttttagcatccatttgcattattctctaaaatatactttattctttgtttttccgtaacttttaagaatatccaattttgctgccttcgataacagtcgacttgccgtctttatttccgctttcaataattttgctgcaatagagctatttatttctttatttgtatcgagatagtgcaaaattatctgcattcttgtcctttccaattcggacattgattcggacattgattcagacattgtctcatttccttcaaaattttgagggacatcatagttcagattcggcatcactacagtaaactcatatctgtctgagcggaatgatggtcttttactctcattataattaatttgaaattcatatccactgataatctttccaaatccactacctttacgctccatatatccaagccggttgaatacatcggcaagaaccggatttcttctggtagaagctactgtaaatggatctctgtcttgaatcatggaaccatccggcattcctcccggggaataaatttccattctgtcatcatatatgtcaatatgcacttcacttccattcaccagatagtcacggtgagccaaagcattaacaagtgcttcgtgataacttcgctctacatactccggcatttcttctcttgaatttgcaatcttacgccacttcattttacaattacgcttgatgaatgcctctccattttcaatcagtgaaataacactacctgaatactccacatcatctaacgcatcaactgcgccaccacttttatttaatccattccaccttgtacaaaataatcttgaacaacgaatcggactttcatccgcaagtaatgcccctgcatttgttaattcgcaccgctcatttaccaatccaaatgaaatctttaccatcaaagctattccctatccacctaaattacttataataccttctctccttcacattcaaaggtatccttcaaaaaaatcctgtattctcttctttgtgtatttattctcaacttcttttaatatgtacatcgacaattcatttagcgaacgagtaagtgctacataaagcttattcttggtcttattcatctcggtattatcgtcaaataaatatgccgccaaatcgttagtaagaataaacaaacacttctcaccctccattccctttatgtagtctattgattttacaaaaatcttatcttcctgttttattgggctttcgtcttcaaaaatatttatgataatgccatatcttcttgaatctattttttcacacttgctcagtaatgccattgcatcttttttctttcccgtattcctgtacttttcaatcatcttcccagcataataatacgctactttttttactgtcagagtatctttggttggatgattctcagacaacaatggttcaagctcttccgctaaattctctctcatattatttttcttgtagtcatgcgtttcatataccccttgcttctgggatatatacatcaaatcatatttttgactttcaattaacgtgcgacaatcaatttcactttcataatatattgacaattgtccggaatctttttcagatttctgtttttcattttcatctactaaacgatttgacagttctaaatgtaattgcggacatctatggcattccgatatatatctaacattttgcttgtatatagacataagattccttaagcatttaaaaccttttaaatcctgttttggatctcccatcagcaacatggggattcccattctacttaattcttctataatttcttgcatatgcttatctatatcctgtacttcatctatacagattgcgccgcaatattttgcaattgcatttttaatgattactctgccattctttatactttttgtgtcctttgattttttacataacacccatttagcatgttcaggaattactgtttggtgaagtacattcaactcatcaagtcttttaatctttgcatttttatactttgcatcttggggtaaatccgaaatagaaattttttcatatttctttccataaagtaaatgataatacggttttattatttctctatacagaaatgaatgaatcgtactcactattatattttccgggatttgtacataatgttcacataattttctacgaatgcaatctacggcactattagtaaacgcaacgcaaaatattttcttattctcatctatttgattacgaagaagtattattttatctgacatctttgtagtctttcctgctccggcccccgctatatttatttccactttataacacctcttcctgctcttgagaaagaaaatctaatacatcttgaatatgtttgggcatttgaaatccttctaatccaccactagctaaatccttacaaatagtaaacatatctgatgcttttgcatttttccatgcttctgtaagctgctcagctgtcatattactccaaccgaaaacttctccatatttttccttcaaaatattaaagttgtcaccagtatttacaatttccggttctaaggtataatactctgttgtcctaacacatatttctttatcatcattatacttatcatgtcgtttctttgcatcaagttggtcatcataatctcgtataatgcccaatttgttacctgaaccttcattgatttttttccaaatattcattattttctcaaatcccttatggaatgatagcaattcaatctcactcaaagatacttgcgagtcaatataagagcgaattagtaattcttctgatattccctcaaacaaaacacatttcttagagaaaaaaagcttaaaaagatccaaattaggattctttgctaaatatgctatatcttcatcttctaattcgtcaacaaacgaaaatgcttttcccttatgtaaaaccaccacatttttcaaattcattttattaataaattcagtactatgcgtggagtagaataactgaacagttttattcttatctgtaaatgcttttagaaaactgaccatcaatctagtattgttaatgcataaatgagcttctggttcttcaatcgtcaaaacattcagagcagtatccgaatttttaccaatcaacgaattaatcagaacaaacaacaatactaagttacgatgtcccaacccttgcattgacagttcttcttctgaataccctaatcttacactgtttaaaatagattgcattggtggcatattaggaagaatattaatatgtgaaaaaaacttctttgcctcttttagctccgatgtatcttgccagtttattatgtcattgatatcactaattttttttaaagactcaaagaaatggctatattctttttctatttttaatttatcctgatctgaaagtccatctttcaataaatcaaccaaaaattttgaacctaattgatttttagttcttgaaaaatcgtctctttctgcctcaagagcctcatatttgaactgctttaatgtgtcatatgatatattactgccatcagaaacctttactgagtaattataatattctactggtaagagattcattttaacctcattcaaattcgcatcattgatttcattctcagatacaatttcctttaccattctgaatatatcttcacaactcttaggtgcaaactcatattttataccatattgaattttcccatctctaatttcatatgacaaatccttgacataatactcctccgcaccacttgcctgaatattaacttcaacacttactattggcaataattctacaaattgctcaatagtaatctcgtcattcttaattttattctggttttcaataattttattgtaataacactttttagtttcattatttatatcagaccatgataatttcttactgatatgtatattatcatcggttaaaaaaggaagcgtaattgcttttaagaaattactcttaccactattgttttctcctataattgcaactgtttctgctaagcctatgtctatattccttaaattcctataattgcatacttttacatgcgtaatcttcaaatcttcacttccttttcacaatacagctatcaattgttaagtagatatatttttaaataatgccttctccaatcactctttgtacttcctccgactttatcaacatcctcatcttctcactaccatcatcaatctcaggctttccacacctaagactatccgtatgttcagatacacaacaatccttataccagcattcacccataagctgccccttaacagaccacttctcgttttgtgtaaattcacccaccaatgatttcatcacacgctctgtagagtatctcttaaaacctgccaagtactgtaatgtcttctcatcatcaatctttgacaagttgattctatgattctcaattgctgataaaacctcttcacgaattttgattttatctgtctttccggtacctgtccatgccaccagcttatcaaaagcaagaatcaggtattcaaaacaaatcatatccagaatgataatcttcccttctgccttatcttctattgatttcaacatacgatacttattacgaatatcctgattatcaaccacacaatcaaacgcaatataatacttatcgtcctctttaatgtctatctctgccaatgcatccaataagccctgattgctttctttactttcgaccacaagtgcatcatcaaagaaaagctgattgactaacttccagaagtggagtccagcaccagtgtcttctgtccataaatatttcatatcacaactcctcttccagtgttatcctattattgccaaacttcagcaccttaaaactcttatctgaaacattgaggccatcacaatttcgtaggaaaagcatatattgattcgacggctcaaaattaataaaacgtctgatctcatcattaatcaaattatctgcattatcgactacaataaaactatctctgcactgttcaatcgattctgagaaattatctgatttgtagttaaacaactttatagctttgtattcattagttaatcgtagatcttctaacatttcataaagcactgtttttccagtaccactatctccaccaacaagagtaatcctgtcatcaaattctaaatcgtatgaaaatggatctgctttaaatgtaatattcttataaatcatctgcttctctcctttcatactccttactccaccaggcattataacctctccctccggtcactatatcagaatcattgaatctgatttgcacatcatccgggatatcaaaaagcgttggtctggacatgtaaatttttatattatccatagaaaaaatgattctaagtacattcggaccacattcttctacatttactaccttatcaggatgctttacgatattaagtaatgtcttgcagccagatgacaaattacggattgtacctaaaccatattttgtttcaatgtgcttgtctggtgtcagctttgcctcatctactttctgaatgagatttatttcatattgggacatttcttcattacttgtattcaaattgaaatacaaatcgttttgaagtatccagtcgttggaatcttttttttctgtatatatatatatcattcggtgtcactccttctctctatcataatcaggaacaaatgttgccatttcttcataatatccagcaatacaatttaagttatcacctatctttttgaatatctccacaaacatctctaaatcaacaacttcatttccataattttcgatataaaaatgatattcgtcatcggcattaaacggataccgtgaaaaatccatatttttcatctttgcattagcattatgatctttatctattttgtcatataattctaaaatatagtcgttcagttcttttgtcatttccttaaattgttttcgttgttctttatcggtttcaaaacctatcatacgtttctttactgtgttccatatttgcctgatatcgtgacctccacaaaatgactctttcatgttcagcaacatatccaaagaccagtttatagattttagatacaactctattgcatggtttgccgaaaacagcattgggaaaactacaatatccgcctttttatctccattatcctgcaaacaatcttgtgcaagcattatcgctgccttcatgtatccatcagcaataatcatcatatcatgaatgggttgatgctgtctggttctccaattcatatatgctgttttgtctatatctacattatacgaaaaaatcttttccattcattcacctacttttcaaaactatatatttaaatttctaaaatgcctaaaatctataaaatatcaaccaaataccttccaccaattaatgaaaataacacttttgatgaaaataatctttcacccatactggaaaacccagcaacagtcatagtccaatcactgtactcattcggcaatctataacatatcggcttatcattttcagagattgttactaatggggtcctattctgtgaaaatccaactgaaagaacataaaactcattctgtccactatgtaatggcaacataggttgcttgttaatatccttataaacctttgcgcctctttgattataaaaataatcttttccattttctactataggatcaatcggtaatttgttcctcattattttataacgttcgttcaagctctcgcagacaaaagcattataatattctggttgcatttctatcttactattacgaatctcatctgcatctgaaaaatgattcataaattgaagaagtgctacaaaagccaccaaatcatccgaataaattccagaaaaagatttgtaccaatagtcattattctcacaaattaccctatataattttttatacaaatcaagctgtctttgattcaatgcaaaccagcccgaatctaaaagtgtcttcttcattttcccatctttataatctccagttaacgatatcttcaatgattgcatcaatcgagatatcaatccagcaagaatatcagccattctgattccaacataatccttagaatcttcttcgatgacatttttaagtcctacattctttgcagaattcaatgtatgcgattcttttccttctcggtcaatcatcaactgatattcattaacattcatctctgtcaacaatttcttaaatccatcaaaaggtgcaaaataggaccaatctaatgtttcgggtacctctgtgtcctcaagcagtaaaagtatttcctgaaatgcttgattctcatgctctttcaaagcagtattcgcttgatttttaataatcctatcttctaaaaaagaccgtagttctttaacaaatatttgtggctctttataaattgcttctatcacattttgtggtcgatatacattgatagccttaattattgagtatttcatgtaatcaacatcaacaaacatagaattatgataatttacaaacagctggctaataacatactctattttgctaaacacagagaaataaataattattttctcgtcaaatagtgatacaaggtcttcatataactcaatcgtacgattattaagagaagcaaacccaagcctaaaatcttttgctttcatagtctgactctttaattctccgtctttttttctataatcatacttcgattcaaaagcaaggtatctgtcagaaatacatttatcatcttctgctttccaccctacaattcctgttatgaaattatcatagtaattattcgcggtaacagtttcataattaatctttctactatgttctgtttcatcatagaaaaaaatgtacttcatcttcagcacctccctactgattattttttgaatcaccataatgtatcgaatcttctgccaccttcatcaccttatactctggctcatattgataaatctttacagaattatctacttcattttcttcatcttctgttacggaatactcctcaaaattctccacctgttccataactttgttgaatacttccggactatactgtggtggataaccattcttcaccaagcagatttttatatcaagttttaattggttacgaacattctgattattgagccaatctgcaaatgaggattttgtatcggcaaatccaaagatggattcaaacatatttgtttcgttttttctgccattctgttacatatattattttggcccgctgattttctgttgccaatttgttgccacttcaaagcaagcatagcataagtgtttcacaatcgttattttgaaaagactgcatcatttctggaaagaagatatacacaatactggttcatgctaattccttctctttgcgaatgttctgccagtgatctgtgcaggctccgaggaattctcagcttaaactgaccggaataatcttccagactgtctggttcatgaatctccacgccatcttccaatgcagcttcaagccacgcctttttcgcatccagtgcattcgccaccgcactttctacagtttcaccacaggtaatgcagccaggcaaatccggataagaaaccacaaatccaccttcatctttatcttctacaatttccatacgataagacattgccatgtaatcattcagcgtcttcatcattcttcgcctcgctttctacaatctgccgcaccatttccacataaactttcttgattggttcatgcttcggtattgtaactggcatacagccctgttttctgaacgtataatgactgcttccgcttctcggtgcattcatctcatatccgtagctttccaatattccgcaactcttcaaaccggaggtctttcgataaattgcatatatgtgttatcagtttatcccactttgacattctttatatctcttgattttattttatgtggtatcgcatttggtgtcaacttttttattgtatgtcgcctaaaaatctgcataaatatttcaaatttagtgttgacaaattgtaactcatgttgtatgatatcaaatgtgtctggcagacataaccgacacaacaacctatgcgcgagtggctcagttggtggagcacgaccttgccaaggtcggggccgcgggttcgagtcccgtctcgcgctctcttttaataaaaagggcatccgatggatgtccttttttgttaaatcgagtcctgccggactcgaacattcgagtttcttcgctccggtccggtcgttgcctaacagcgtccaccggacgctgacttcttcgctccgctccggtccgcgcagaacagacgtccactggacgtcttgcttctccgttctactccggtcgttgcctaacagcgtccaccggacgctgacttcttcgctccgctccggtccgcgcagaacagataaatctatttgcccttgtctaatggcataatgatatttcgttaaaagttaaatcaaaaaagacatcaaattctacctgtcaaagtagattgatgtctatttttacctataaaaaatgggcactgccatatcagcggctgccacacaggcagcttatgttacatatattcacacactaatatgggcttacatacccctcaaatttctattggtgtcctaacatatagtatgtgaaaatacaagcgtttattcccattctgctccgtattttataccaatattttcaacactatatgtcttattttccgaactttcttgaatgacattcggcttccgatggatgtcatttttccataccgagtccttctcctttacttgcaggacttacaatacagttccgcccacatcggcacaaatcccgccccaagtgctactctctgcgatgctatatgtgacattgaggtgccataaaacggaagtttcccgcgctttaagatctcgtttttcaggaccgcaacaagcatggaacctattccaagtccttctgcctccggcatcacattaattccaatctgccacatgctgtcgctgtcgcttgtagcgcccgccatgccaagaaggacgccatctctgtaagctcctaccccaatttcatccttgggcagctcatgaaagagaaatgcttctccaaagcgttcatctcctctgaatggctccagttcttctccctcaaagattcggatctcataatctttcgtgtctacctcggacatttcggtcgcaatataaaatggatgagcctgtgcaatctggcagtggaacatttttaaacctgcttccagctcatgtaaagcttccacgtccatgaaccaggcgccgcttctgtctttaaatgtttccctcacccatgcaataatatccttcttaccggatgcaagaatcttgccattgatgcaggcaatcttcagaaaacattccccttcttcaaaaatcctgcgtccctgcagcggggtatacaccgtgaagatattttccctgctggtaactgctccttcctctgtacagaaatcaatcgccagctgctttaccaatatctcgttcatacttttccacaattcttttctctctccgccatccagcgctctttcgtcattatatttcgatgttcggtacgcgcttccttcattaacggcacggataccttttcccgtgtgtgatgatatacaaagccaatcttctcctgcactctttttgacttctgattgccctcaaaatatccgcaccatatggtattcatgccgagatcttcaaatccatgacggatcatttctcttgctgcctccggcatatagcctcttccccagaaaggttttccaagccagtaccccagctcacattcctcgtcatgattttccgtatcgttatgtctgtttaatatcagttcaatcgcaccgattgcttttggatttcccttttcgcagatcgcatagcactctctgccgtttagtacattccggatcacatccaggctttcctctcttgaccggtgcggcggccatcctgcaatcggaccaacctccgggtcttttgcatattcaaataaactgtccgcgtcttcctctgtccactttctcaatagcagccgttccgtttctaacatatcgtattcctttccattccctgccgcgtaaacctgcccgctttccaaacagaaacggttctactccgcacactgttcttttgcttcggcatcgggtcctaacattcccagcttaaaatgtcttctgcagagcgccacatagctgtcgtttgctcctaacatgacctgcgggccagagcgcacaataccatgctcgttgtatctcgtattacaggtagcttttctgccgcaccagcacaccgtctttaactcctggatcacatccgcaatcgcaatcagacgctcactcccagggaacagcaggttacggaaatctgcgcgcagtccataacagaccaccggcacatccataaaatccacaatatcagacagaaaatccacctgctgcggcgtggcaaactgcacctcgtctacaatgatgcagtcatatccgcgaatctcctcctccttcatctgctgcagttcttctaacagaatgcagtcatgttgaagcccgatccttgaatataccgtccgctcgccatctctggcatcgatcgccggtttacataacagcgctttctgtcccacttcctcatagttaaaatgcgtcatcagcgcatttgccgtcttagaacttcccattgcaccatagtaataatataattttgccatcaatccaccctctgtcgctgcctgccgcccacttcctgcatacagtcattttcttattaaaaagcgctgtgcgccacttctatccattatacctgtacttttctgcaccggcaagtacctttccattctcccgtgtccacattccatttctcccgtgtccacattccattcttcttgcacaccacccattttttcgctataatatcttgtgcacgatttacgaaaggcataggatgatgatatatgaataaaaaagatatcttggagttaaaaagacgttttaaaaaagatgcctgcaccttcaccagactctgcggctgctacgtcgacgcagaccgcaacaaggtcacaaccttcggggagaccttcttaaatctggaggatgaggaattctataaatacctggaaattgccaaaaaggttatgtccggcacgatcgacaacaacattctggaactggaatttccgactgccgaggaagcaccgggcggaagacagcagtttttgatgggtctgcgcgagagcgcattaaaaaacgatgacctcatggacaccttctatgatcttgtcattgagaattacagttatgtcgggaattatctgattctggtgttccatgatgcctatgatgtgatgacgaagacctccgacaacaataagctggacgagtccgaggaagtctacgagtatctgctgtgcgccatctgtccggttaccctgaccaagccgggacttggctaccgcgaggacgagaaccgcatcgggccgcgcatccgcgactgggtggtcggcgttccggacaccggtttcgtttttccggcatttaccgaccgcagcagcgatattcactccgtgatgttctacaccagggataccaagacaccgcacgcggaattcatggaatccggtctcggctgtggcaccaagctgaccgccaccgagaaaaagctgacattccagagcatcgtcaaagaagtcatcggtgaggatgaggaagagagcgacgctgtcttcggggatatccaggaaaatctgaacaatatgattccggtcacggaggacgagacggtggaaccggaaccggtcatcgtcaccagatccgccattgcagatgtccttgcagaaagcggtgtcaccgaggaacaggcagccgtcattgagaacacctatgaaaatgtatttggcgaggaacttccggaagccggacagttagttgatccgaagcttgtggaagccaacggaaagcgcaaagaaaagctggagctggtaaagcaggtggaaaacttaaagcaacagctcgaggagacgcgctccgttccggtctcggagggagatgccgatggcgaagatgtccctgccgtcaagacctacgatgtcatcctgcgcgtcaagccggaaaaagtcggacagattcactcccaggtcatcgacgggcagaaatgtctggtcattccgatggacgaagatgagcacgccgctgtcaacggtgtcaataccaccgtataatacggatcgatgcaatcgatgacgcatggaatatgttccataccggcagaagccagcagtgacggcattcatgccaccgtatcctattttgcataaaacccgtcatgaaatgatttcctttctcatttcatgacgggtttttcataacaatcctgtttcagacgcaggcacagcgtttattgcgtcagccgctctctgatatactgctccatctcatccttcggtatgccgagtgtgagcgagagttcactgtacagttcattctccgctgtccgcatgtagcgctcgtccagcgccgtgatcttctttccctgtgccgtgcgctcctgttttctgatgtatagtgtctttacaatgctgacccacgcacggtaatcgcaggtgttcattgcctccttgtatctcgcctctctctgcctgtcatccggcacccagagctgctcgatcttaggcatatcctcaatcagctgatccgcttcctccctggaaatcactttgcgcatcgtaatcttctgattgtccgtcggtgcatagatccttccactgccatcgccaaccggggcaagaacataatacaaacggtctttatccgccccggaaatgtcaatgtgggtaatatcctcaatccggcatacacccttcactccatacacaatatactcaccgatctcaaacatcttccccgattctcctttcatcacagttttaaagcatccatttctattttaacacgaaaaatcccgatttaatcaatattttccgcttttttccaattttcgtaactattgccagaaaacaggcggcgtatgattgtacatatttgccaaaataggaagtaaaaaagactcctgtcacagaatttttgcgccgggcgcggtcatgcggcatgcttccaatttgcgcggtcacgcatcttcacaacgtatttttgtgtgacagggatgaattctcccaatcgagtaggaggcggtgtgttgttcacgtctgtccaaaatctctgcatccgctttttcaaattgttcgaacagagccttttgttgttctgtttcgagatgcacaacagtttcaagcaatttgtctttgtctgtgccgtttaatatacgttgcactatttttttagcatgagcatctttatacgatcttaatacagcaaaccagatcattacaccttttttttgtatttcacgttatactctttgtaaacaagcagaaaaaggagaagtatatatgcttgaaattatacatagaaaaaaacggctgtcatcctttaagctgatcgctctgggttttgccggagtcattgtacttggagcacttatcttgatgctaccattttcatcaaacaccggatctgttacaccatttcatgaggcactgttcacttcaacctccgctgtttgcgttacggggcttgttgtgcaggatacaggcagctattggtccgctttcgggcaggcggtgattttgctgcttattcagataggcggacttggcgttgtgacggttgctgcaacatttgccatgctttccggcagaaaaatatcgctgatgcaacgcagcaccatgcaggatgccatttcagccccaaaagtcggcggcatcgttcgcctgactcgctttattgtacgtgggacttttctgatcgaacttatcggaatggttgccatgctaccggtattttgcagagatcacggtttcaaaggaatttggatggcggcgtttcattcggtctccgctttttgcaatgcaggattcgacatactcggcaccaccgaaaacaaatatccatctcttacgggatacgtcggagagccgacaataaacattgtaattatgattttaatcatcgtgggcggcattggctttttgacttgggatgatatctgtacaaacaggtggcatttcaaaaaataccgtatgcaaagcaaggtaatattagtaacatcggtgattcttattatcgtccccgcaatattttttttcctcttcgatttcacaggactgccgcccggtgagaagatccttgcctcgctttttcagtctgtcacaccgagaaccgccggattcaacaccgccgaccttaccgccatgactgaatcttccaaagcaattatgatcctgctgatgcttgtcggcggctcacccggttccaccgccggcggtataaaaacgactacgcttgccgttctgatcttgaacgcattttccgtctgccgtaaaaaaaacgatactgaagtctatggcagacggcttgaatgctcggcggtaaaaagcgcctcaaccatcgccgtaatatatttcctgttattttttatcggcggcattattatcagcacggcagaaggcatgccgcttagcgcctgcctttacgaaacggcatccgccgtcggaacggtcggccttacgctcggcgtaacgccgcagctcagtgttttttctcagtttattttgatcgtcttaatgtatctgggaagagtcggtggacttaccctgatctatgcggcgatctctaataaaaatcagagcggtgcaaaactgccgctcgaaaagatcacagtcggataaaggagttactgttatgaaaaacatattgttgataggtctcggcagattcggtaagcatattgctttacaactgaacaaactcgggcatgaggtgatggcagtagacagcaacgaagaaagaataaatgaaatcctgccgatcgtcaccaatgcacagatcggcgacagcacaaatacggagtttttaaagtcgctcggtatcggcaactttgatgtatgtatcgtcaccatcggaggtaattttcaaaactcacttgaaactacttctttgctgaaagaactcggtgcaaaattagttgtgtcccgcgccgagcgtgatgtacaggcaaaattccttctgcgcaacggagcggacgaggtcgtttacccggaaaaacaggtggcaaaatgggcttctattcggtataccgccgaccacattcgggattacatcgaggttgatgattctcatgccatttttgaagtagaggtaccagaggaatggatcggcaaaaccgtcggagagctcgacatccgcaggaaatacagcatcaatattatggcgactaaggagaacagaaaaatcaatatggcagtctcgccggaaactgttcttacagacaagatcacacttttggttctcggtgcttataaagagctgcaaaagtgttttcgcatttaatagaggtgaacggcattggctgaactattgctgattatcagcttgcttggcgtatttgctttcggcttttatcttatgagcaggctggaccaatttcttgagaaaaacaggaaggcgctgttaaaagagaacaaattccgtgagttttccgaaattttgctgccgcaaggactgtccgacagtgagatattaagcgagatccgccattttcgggaaacacacggaaaagtcgatattatcctttctgacggaaaagaggatgcgttttagtttacggtagaagatttcacgattttgttgtataatgaaaccaaaaaggcggtgaaaccgatgcaaatacaaaccgaacagccaaaaaacggtgcggacgagcatatccttgtctgcctttcctcttcaccgtccaatgcacggatcatacataccgccgcaaagatggctaaggttcttcatgcaaaatttaccgccatctatgtgcaaaccgattcggttgaaagcgaaaaaaatcggctgcggcttgaacaaaacattcagcttgcgcaagggcttggcgctgagatcattatgacgcacggcgaggatgtgccgctacagatttcggaatatgtccggctttcagatgtgaccaaaatcgtgatcggacaaagcagcgcccgccgcagaggactgtttggaaaacccaccctaactgaaaaactgatttcggtcgctcccaatgtggatattcatatcattccagacgcactgaactatgtaagaccgcaccggcgccgtttgcttttcggtgcagaaacaccttcgttgcgggatattggcgtgaccgttctgtcacttgccgtatgcacggcgatcggttttttgttcgatcatctcgatttccccgacacaaatatcgttacggtctacattctcggcgtactgatggtctccgttttgaccaaaggatatctttgcagtatggcaggctcgcttttaagtgttgtattgttcggatttttccttaccgaaccacagctatcattcaaaacctatgctgtaggctatcccgttacctttgccgtcatgctggtagcttccgttctcaccggcacgcttgcctcgaagcttaaggatcatgcgagactttcagctcgttctgcgttccgcacgcaggtgctgttcgacaccgaccgtctgctgcaaaaagcgaaaagcaacgatgatatcttaagtgtgacctgtatgcagctctcccggctgcttgaccgcagtattgttgcttatacaaaaagtgaaaatggaatgtcgaccggacggcttttcgccgaaaaaaagtacacatactctgaaaatctgctgaacgctgcagaacagaaagccgcagaatgggcatttcaaaacggtcgccgtacaggagcaacaacagcacagttcggaaaatccgaatgtctttatcttgcgatccgtgcagggagcagagtctatggagtgatcggaataccgatgagacctgaaaagcccgattcattcgaaaacagcatcgtgctgtcagttgtgaacgaatgtgctctggcaatggataatacacacaacgctgctgaaaaagaacgggcagcagatcttgcaaaaagcgagcagctgcgcgccgaccttttgaggtcgatctcacatgatctacgcacgcctctttgctcgatttcaggcaatgcggacacacttttgcataacggaaactgcttggacgaaacgacaaagcaacagatatataaagatatatatgacgattccgagtggctgattgacgtagtggaaaatctgttgtatgttacacggctgaatgacggacgcctgaagctggagcttaccaaccagcttgtagacgaagtgatcagtgaagccgtttcacatttgaagcagaagtctgtcgggcacacggtaacggtgaagtgtgacgatttgattcttgcacgcatggacgcacagcttatcgtacaggtcatcgtcaatcttatcgacaacgctttgaaatataccgaacaaggctcggagatctgcgtaagtgcagaaaagcaaggaaaatacgccgtgatccgtgttgcagataacggtagcggaatccccgacgatatgaaatcgcatatttttgaaatgttttacactggaaaaagtacagttgccgacagccgcagaagctttgggatcggtcttaccttatgcaaatcgatcgtagaactgcacggcggaacgctgacgcttagggataatgtgccgtgcggctgtgtatttacctttactttaccgcttagcgaggtgactctgaatgaataaaccgcttatacttgttgtggaagacgaccgcccagtccgcaatctgatcgtaacaacattaaagtcgcacgattaccgttatctgactgcggagaacggacatggtgcgattatggaggcgacctcccataaccctgatatcgttctgctggatctgggtctaccggatattgacggcacacaggtgatcgaaagcatccgctcatggtcgaatatgcccattattgtgatcagtgcgcgtagcgaggatcgtgataaaattatggcacttgacgccggggcggatgactatttgacaaagccattttccgtagaagagcttttggcacggcttcgtgtcacacaaagaaggctgttgctcctgcaagcaagtggcgatgccgacaccccaatttttgaaaacggcgagcttaaaattgattatgccgctggttgcgcttacttaaaaggggaagaattgcatcttaccccgattgaatacaagcttttatgtctgctctcccataatgtcggaaaggttctgacgcacacctatatcacacagcagatctggggcagcagctgggaaaacgatattgcctcgctgcgggtgtttatggcgacactgcgtaaaaaactggagctgcaaaaggacagtccgcaatacattcagacgcatatcggcgttggttatcggatgctgcgggtagactgagaaaagcgagaaaacaagaaattgaaccgatatgcaatagaaaatcctttcggaattcaagagcgcaatatccgcttggtacggaatcatcatcacctacggtatggtgcttggttttgctgtggcaatataccgtttgattttcgaatgggataataacaaaaacgacctgctttctgttttagtagtcaatccaggcggccttgccatttacggcgaagtacttggcggtgtcgtagttgcattgatttaccgtaaagaaaaacggatttccccttttgggcgcttcactcaccgttaatatcacaggtgctgtccggctacctgattattttcggtatcgttacaatttttattatctgtaaaagaaaggcgatgcggcaatgagaaaagaatggactttattttttacctttcttaaaatcggcgcttttaccttcggcggcggatatgctatgattgcgttgcttgaaaacgaatttgtagaacgcaagaagtggatcaaaaaggacgactttctgaatatggtagccattgccgagtctacacccggaccggttgcaatcaacagcgccacatatatcggctacaaaattgcaggcttgttcggtgctgcggcggctaccgtggcggtttgtattccttcgtttaccgtaattttttgcatctcactgttttttgatcaattcttaagccttacatgggtttcccgtgctttccgcggaatacaggtatgtgtgatctatctgatttcctctgccgggctgaaaatgctgaaaaccattgaaagaaatgccttcaacacggtcattttgctgtcggtcattgctgcaatgctggcgtgcactgttttcgccgtttctttttcttccgtttactatattctgatttgcggtacagcaggacttgcgattttcttcctgaaaaaactgcggaaaggaaacggcaattaacaatgatctacctgaaattattcctgaattttttaatgatcggtgccctttccttcggcggcggatacggaatggtttcccttgtaagagaaacagtcatttcaaacggctggctaacggaaagcgaattcttaaatttcattgccgtttcggaatcgacgcccggtccgcttgccgttaatatggcgacatttataggttccacgcaaggtggcattctcggctcgtttcttgctacgctcggcgttgttcttccgtctttcattattatacttttaattgcggcggtactcaaaaacctgatgaaatatgccggtgtcaacgcttttctctccggcgtccgcccctgcgttatcgcaatgattctcgctacggcaatcggtatggccatatcaacattgcttggttttacggatatttattcggcgcttgctccggatcctaaatccattttggtctttgccattctgtggctgacacatttcggatataaaagaatcaaaaaaactgcaccgtcgtcgattataatgatactcttttctgccgcactcggcatactgctttggggagtataaaatgcatcctatgccaatttgccgtccgggaatcgggcggctttgctaattgtttggggatgcactgttcgtcacctgtctgaacgattatctggagtaaaactcagagataaacgtcgcggaaacctttgaggtttatgcagaaaatgaatttaagtatggaacatacaacgaagaacaaaactcacgtttagcatcaggacataatctaaagcctgttacaaccaatttcacaggacgcaaaccagatgaaatatatgcggattttgtttttatagatgctggtaaatatctcatcaaatgtaagaacaattgtgtacctgaagaacgtatttttctaaaaacatgggtgcgaaaggaagtattttggaaatccgttggttgtacaaagcaattacatacatgcaaacagaagaattctctgaatactcataatttagaaatagaattgaggcaatttcatctcttctccgccaaaggtatcatgtgaataggaaagatattagattataccaatagcttagattcgtatgcttcaaataagaaaacagcataaaatcaatgaaccacagtttcaaaatatcaataaattataggctcaaaaattatatctttcacaaattcgtgttaaattttcaaggtacaaacaacctcaaatattaaactgtactttcggcaccctaatcccataaagtcaaaaagcgccccgcaatgcggggcgctctcttctgcacagctcaaatgggtaaaaattcactgtgctgcagactgtggcagggaaaccacagcctcttggtatattaaattagggaaaggaattaacttaaattatttgaaatgacagcttacgctattatctctgtacacgtccggaagcatcgccgccagccagtttcttgacctcgtcaacgcttaccatgttgaagtcaccctcaacagaatgctttaagcagcttgctgctactgcaaactcgatcgtagactgcggatcgtagtcgtttaagcaagcgtagatcagtccgccgccgaaggaatcgccgccgccgacacggtcaacgatgtgcattaagtactccttggagaagtagctctgaccatcctcgtaaagcattgctgcccaacggttatcgtttgcggagatggaagttcttaatgtgattgcaaccttcttgaatccaaaacggtctgttaacttctgtgcaacctctttgtagccttccttgttcagttcgcctgcggtaacctctgtaccctcagacttgatgccgaatacgtcgtttgcatcttcctcgttggagatacatacgtctacatacttgcaaagctcgcccatcacctgtccggctttctccttggaccacagcttgttgcggtagtttaagtcgcagcttacagtaatgcccttagcctttgcagccttgcatgcctctaagcagattgctgcaacgttgtcaccaagtgcaggagtgattcctgtgaagtggaaccagtcagcaccgtcaaaaatcttatcccagtcaaaatcagcagtcgttgctgttgcaatggaagaacctgcgcggtcataaataaccttggacggtctctggcttgcacccttctcaaggaagtagatacctacacggtcaccgccgcgaacgatatcggaagtgtctacaccgtactgtcttaatgcattcacaccagcctgtccgatctcatgagccggaagctttgtaacaaagcttgcatccattccgtagtttgcaagagatactgcaacgtttgcctcaccgccgccgtaagtagcgccgtaggtaccagcctgtacaaaacgatagtatccttccggtgcaagacgaagcataatctcaccaaatgtaacgactttctttgccattattgaatcctcctaaatgtatgtttcaccatgtgaaaccgtgtttcattttctataataaaattataacatctaataccagaatgtcaaatatgtttttatttaagtccaaaaaaattccaaattatttccgattttcacttttctattttagcaggatgatatataataaaaacagattggttcacattacagaactatgtttcgcaatgtggaacatacatatcgtatccatagacacagtgtgctgcattttctcataaagcattctttttgagatgccgtgacgtgtcggaatttttactttcttatttattcttacatcatcaggaggagattatttatggaccgtaaatacgatgtcatcactttgggggagattttactccggctttccacgccgatcaacggacgtcttgcacagggcgacacgctgatgaagcacctcggcggtgccgagctcaacattgcttccgagatcggacagctcggccttaagacagcaatcatttcaaagattccgaacaacctgctggccgctttcatcaagaaccagctcaacgcttcccgcgtcagcgagaattatctgatcgaggatcactcggacgacagccgcgtcggcatctactactatgagtacggctcctacccgagaaagccgcgtgtggtctatgacagaaaacattcatccatcaacaatattgacatcaaggacgttccggctaccatgttctacaataccaggctgttccacaccagcggtatcactttaggactcggcggcaacgcacagaagttcgcgatcgaatgtatccgcaagttcaaggagaacggcaccctgatctccttcgatgtcaactaccgcgcaaacctctggagcggcgaggaggcaagaaaatgcatcgaatccatccttccgtatgtcgacatctttttctgctccgccgacactgcccggctgaccttcggcaagaccggcacgattgaggagatccagaagtccttctgtgaagaatatccgatctccgtggttgcctcgactgagcgcactgtcatcactccgaagaagcacgactttacctccatcatctactctgcgaaggaagaccgctactacagtgaatctccttacaacagcatcgatgtggtcgaccggatcggaagcggtgacgcctacgtctccggcgctctctacggttacctgagacatcacgactgtcagaaaatgttggagtacggcaacgccatggcagccatcaagcacagcgtcatcggcgatatggtctttaccgatctcgaggagatcgacggcatcatcgcacagcacaaggatacttccggattccagcctgagatgaaccgctaagtatcattttcctgcgaaggaatgaagcgtgcgcctgccgcacactttgcgcggcagataaaaaaatgatggcggcagtcccgcggatactctccgccggactgccgccgtttttattctgaatcttctctatggttccgccgccggctcctttcatcagagccggctcttttccggaatcacgatctttttctcttctgtcgaaggagaacgttcctcatccgcctccggagcatttccggtgcggtgtctcttcacattttcgcaaccagtgcatccggcacggtgatgtgatccagatgccagatctcatccacatactcctgaattgtgcggtcggaagagaatttgcctgcgtgggccgtatttaaaatagcgctcttcgcccatgcctgcttatcctgatagtactccacaatccgcttctgcgcatccacataggaacggaaatccttgaggataaaatacgtgtctgcatactgcgtgcactgcgtgttgagcagtgaattgtagagatcacggaacaaccccggatcgttcggcgaaaatgtgccgtccacaagctgatttaccaccttgcggataccctcgtcgctgttgtagatctgcatcggatcataatcgcggttgcgctcatgcgcaatgacttcctcggagctcatgccgaaaatgaaaatattctccattccgacttcctctgccatctccacgttcgcgccgtccatggtaccgagtgtcagcgcaccgtttaacatgaacttcatattgccggtaccggatgcctccttgctggcagtcgaaatctgctcgctgacatccgccgctgcgaagatccactccgcattggacacgcggtaatcctcgatgaatacgaccttgatctttcctttaatgtccgcatcgttgttgatgacgtccgccacactgttgatgagcttgatcgtaagcttggcgttccgatatcctgccgccgctttcgcgccgaaaataaaggttctcgggtagaaatccatctgcggatttgcctttaactcattgtacaggtacatcacatgcagaatattcaagaactgtctcttatactcatgcagacgctttacctgcacatcgaaaatggaatccggatcgacttcgatgccgttatgctccttgatatactctgccaggcgcactttgttcctgcgcttgatctccatgaactccttctgggcttttgcgtccgatgcatacggaaccagacgtgcaagctgcatcagctctgtgatccagccgtcaccgatatgctttgtcacccagtcggcaagcagcggattgccgtgcatcaggaaacgtctctgcgtgatgccgttggtcttgttgttgaacttctccgggaacatctcataaaaatcatgaagctgctcgttctttaagatctccgtgtgcagtcttgccacaccgttgacggaataaccggctacaatggcgagatgcgccatcttcacctgaccgtcgtaaaggattgccatgcgggcaaccttgccgtcatcccccgggtagcgttcctggatctgcagtacaaaacggcggttgatctcatccacgatctggtagattctcggaagcagccgctgaaaaatctcaatcggccatttttccagtgcttccgccatgatcgtatggttggtgtaggcacaggtcttcgtggtaatctcccacgcctcgtcccagccgagaccttcctcatccacaagaatacgcatcagctctgccaccgtcaccgtcgggtgtgtgtcgttcaactggaacgtcaccttctccggcagtctgcggatgtcatcatgattcttcttgtaacgcgccagcgcgcgctgtacactcgcagatacgaagaaatactgctgctttaagcggagctccttgcccgcaacatgattgtcgttcgggtaaagcacttccaccagatttcttgcaagattctgctgctcgaccgccttctgataatctcccttatcaaatgaatccagctcaaaataatcctttgccgccgcatcccagatcattaacgtattgaccacgttgttgccgtatccgaccaccggcatgtcatacgggatcgccagcaccgactgataatcctcctgcacaaaacgcaggcttccatcctccctgctctccgtgcgtacatgtccgccaaacttgatctcgtaagtgtactccggtctgtgcagttcaaacggataaccatttttcagccagttatcaggcacttcgacctgaaagccgtcctgaatcttctgcttgaacataccgtagcgataacggatcccgcagccgtaagctgcgtatccgagtgtggagagggaatccataaagcaggcagccagtcttcccagaccaccgttgccgagtgccggatccggctcctgatcttcgatcacatcgagattcaggccgatctcatccagcgcttcccttacttctttatattccttcagattgatcagattattgccgagcgcgcgtcccatcagaaattccatcgacatgtagtacacgatctttggatcttccttgtcaaatacctgctgtgttgcaagccatctgtcattgatgacatccttgaccgcgaaggagaccgcctggaaaatttcctgctgatccgcctcctccaatgtcttgcggtataaattcttcagattatcgcgcacactctgaataaaggctttcttgtcaaaaacacctgatttcatctagtttcctccttttttcactcccagaagaacatgttcgccgttaatattccattccttgctgtaaacttccggctcatccgcaaatgctccggctgtatccgccacgacattcacgccgagaacgtccgatttaattgtatcaccatactgctcaaaaataccagatactttttcatctgacttgtgatagatcgtgatctgatccatcacctcgaatccggcttccttacgcatggtctggatcttgctgatgatctcacgcacaaagccctcctcgataagttccggtgtcaggttcgtatcgagcaccactgtcacggtgttatctccctcggtcacataaccttccatctgcgttatggtgatcaggagatcctcctctgccagcttgacagactcgtcaacggacggaagtgcaagcacgccgtttgcctttaattctgccatcgccgcattgccgtcaagcgctgcgagtgctttctggatctgtcctaagaacttgccgtacttcggtccgacggtgcgcagctgcggcttgaacgtgtagcttgtgtaagcgctcacgtcgtctgtaaatgtcacttttttcacattcagctcatcctcgatgatctccacgaagaactccggcagtgcagacggagcttttacgaacatgtttccgatcggctgacggttcttgatgttcgcggaattacggcatgcacggcccatgacaacgatctttaagacctcatccatatttttctcaagctctgcatcgatgtacacctcgtttgccaccggaaaatcgcacagatgaatgctctccggagccgtctgatccacggagcgcaccagattctgatagatatcctctgtcataaacggaatcatcggcgccgcacacttgcagatcgtcacaagcgctgtgtagagtgtcatgtacgcgttgatcttatcctgctccatgccctttgcccagaaacgctcacggcttcttctgacgtaccagttgctcatgtcatcgacgaaatcatccagcgctcttgcagcctccggaatgcggtaattggaaaggttgttatccacttccttaatcaccgtattcagcttggagagcagccatttgtccatcacggaaagcttctcataggcaagcacatattttgatgcatcaaaattgtcaatgttcgcatacagcacgaaaaacgcgtaggtattccagagcgtacccatgaacttgcgctgtccctcctgcacgagtttgccgttaaaccgcttcggaatccacggcgcactgctcgtgtagaaataccagcggatcgcgtctgcaccgtaggcagagagcgcctcaaacgggtctaccgcatttcctttggatttgctcatcttctgtccgttctcgtcctgcacatgtcccatgacgataacattctcaaacggagccttgttaaataacagtgtactctccgccatcagggaatagaaccatccacgggtctgatccacaccctcggaaatgaatttggcagggaactgctgcgcaaacagatcctgattctcgaacggatagtgatgctgtgcaaacggcatcgcaccggaatcaaaccagcagtcgataacttccggcacacgcttcatggtcttgccgcagtccgggcaggtaaaggtcacttcatcgatatacggacggtgaagttcgacctccgcagccttcggatcgccgcttttctctgcaagctccgcgcggctgccgatggactcctgatgtccgcagccctcgcactcccagatatttaacggagttccccagtaacggttacgggaaataccccagtcctgaatattctcaagccagtcgccgaaacgtccttttccgatggattccggaatccagttgaccgtattgttgttgcggatcatatcgtccttcacagcggtcatcttgatgaaccaggactctctcgcatagtagatgagcggggtatcgcatctccagcagtgcggatactcatgctcgaacttcggcgcgtcgaaaagcttgccctgtgcctccagatccttcaacacctccgggtctgcttttttcacgaaaatgccggcatacggcgtctccttggtcagttcaccctttccgtctacaaactgcacgaacggcaggtcatattttctgccgacattcgcatcgtcctcaccaaatgcaggagcgatgtgaacgattccggtaccgtctgacatcgtaacgtaggtgtcgcaggtcacgaaaaatcccttcttgtgctgtctgtccgccacttcttttgcgcaggcgtacagcggctcatactccttgcgctcaagctcgcttcccttataggtctcaagcacctcgtaagcctttacctccggcgtatccggctcgccgtccttgcccttttcggctggtgttccaagccgtccgagcactttatcgagcagtgcctccgccatataataggtataaccgtcggctgcctttaccttgcagtaggtatcctccgggttcacgcagagtgccacgtttgacggaagtgtccacggcgtcgtggtccatgcgaggaagtaggcatcctctccaacaaccttgaaacgaaccacagcggaacgctccttgaccgtcttatatccctgcgccacctcctgtgaggaaagcggagttccacagcgcgggcagtacggaacaatcttaaagcccttgtacagaagcttcttgtcccagatctgctttaacgcccaccactcggactcgatgaaattgttgtcataggtaatatatgggttctccatatccgcccagaaaccgacgatgtcggagaaatcctcccacatgcccttgtactcccacacggattccttacattttttgatgaacggctcgattccgtactcctcaatctgttccttgccgtttaagccgagcatcttctccacaccaagctctaccggcagtccgtgcgtatcccaaccggctttacgcggcacatattttcccttcatcgcctgaaatctcgggatcatatccttgatcgtacgcgtctccacatgaccgatatgcggcttgccgttggccgtcggcggtccgtcatagaacgtgtaagtctcgccctgcttgcgctgctccatacttttcttgaagatgtcattgtctttccagaactctcttacctgcttttctctgtccacaaaattcaggttcgtgtctactttgttatacattttttcctccaaaataaaacatttaaggctcccgtcctgtaaataggacgagagcctttatcgttataccacctaattacattgtacacagacttctcccagcgcagaaatcctggaatgtcttcctgctgcctgaaaaatctccagtggagaaaatccgaatacccgttccctttaacgcaggaaaagcgtcagcgcctaccgtgctgccttcctgtctgacacaggctctgctgtgccacatctgcggctgcatttcgggctgcggcttggaagggatcttcgtctgcggcttactcgcaccggctctcaccgccccggctcgctttgcctttcatccacagcttactgtcttcgtcactgcctttgtcaactatgtgtaagtataagccttgcaagcccgcattgtcaaggtctgaaatgccgtttccctgccctccggttctgctccacttgcggtcttccgcttctgcttcacttgcgttcttccggctctgcttcacttgcgttcttccggctctgctccaattgctgccctccggctctgcagactctgcgtctgtgctatctccgctttgcaatcgtcgaaaaaaaacgctccttgatctggtcgatcaaaatgaccgccttaccgtccgaaccggtaaacggtacaaagccacctgccatcgcagcatgcccgccgccgtttccgatcccctgcagcgcctccgccgtgatcttgccggcgtcgagagaagatttttcactccggacggacagtttgatgccatcccctctccttgagtacaccacggaaaaagaaacctccaccagcgccagcataaagtcagagacactcgcgatcaatgcctccgggcagtcctcccccgtatcggcaaagctgatattatcgtacacctcaatgctggaaatcgccttggaatacgccaccagatcctcaaaacacaggttgctgttctccagtgtgtggatctcctcataatcacagtcatcgtacatccgatagagcatctcgatatcgagctttgacacgccgcgtgaaagattgtgcgtgtcaatgcggatgccgtatgtcagtgctgttgcgatctttttatccatcgcaatgtcattttccataaaatactgcgcgatcatcgttgcgcacgccccgacctcggggcggatgtcctgaaaccggtactgacacttatcattgtaaggatgatggtcgatgcagatgatctcatctcccgtaatattgatgatgttggaattgcccttctgggaatccaccagtatcacttcgtcctcatccgtcagcacttcggtcagatcctccacattcaacagttcaatgtcaagaatctcacacagacggccggtaccgtaccggtcgatcttgcccttatagcagatgctcgcctcgatacccctggttgcaagcagccgcttcagaccatatgcacttgcaatcgcatccggatccgggaaattatgggtctgtatatagacatgctgtctgttgatctgctgtagtaattcttcaaactttgtcatgctttctctctcctgcatgcggctgccggctcacatggttccggcgctctgttctctggctgcccggtgctgccggctcacatggtccaagcgctctgcgttttgctcgccgatgaaatatcaaaggtttttaggtctgcaaaggttttcagttccgggaccggctccgcaatctctccgaatccatatgcggcgtggataaacccgactcctgccgcccggctcgcatcataatctccttgaatgtctccgacatagaccgcctcatccagccggttccgctctacgaccagccggatattttctcccttctgccgcagattattgccataacactctatgtcctccaccagttcccacaaatcgtagtggtcaaggaatgcctcgatataccccttctggcagttgctgacaatcgaaagatgatagccgtcccgcttcaacgccgcgagcgtctgcggcacctgatcgtagagtatgcccccatgctcccgcagataatcattttccacctgacagcattcctttaggagcagtctccgtttttcttcggggaattccgcaaagaggatatcggcgattacgtccatcgtttttcccattaccccctgaatgtcctgcgttgtcagttctttctccctgaccccgtactgccggattgccacattccaggacttcgccacattctctgcggaatcccacagggttccgtccatgtcaaatatgattccacgtttcatgacatcatctcccgttctctctcttttgtctaggcttcctcggaaagtccatacagtctcgtgtattttttcttcatgtagcgcacgagcggctgcgcggacacttctttcccgcacactgccgcaattacctctttcggtgtccgcgtgcttccataccagtgaatcttctcattgagccattttgtgatctcaccgattctgccgtctgccaggatctcatccacggagccgagttcctcctccatcttctcgaggtacatgccgtcatagatgctgcccagcagataggacggaaaatacccaaacgagccgtccgaccaatgtacatcctgcaagatgccttcggcgtcattttccggagtgatatgcaagtattcctgcattttctgattccagagctccggaagtttttccaccggcacatgatcgtagaaaatcgctttttccatctcataacgcaatataatatggaagcaatacgttacctcatccgcctcggtgcgcaccatactgttctccacgcggttgatttcacgctcaaacgcttcgagtgtcacattcttaaactgtggaagcaattctcccagtttttcatagatcggcttccagaaattgatatttcttccgagaatattctcataaaagcgcgactggctctcatgcacccccatatagcagcagctgcccgccaccgtattgtcgtattccgggttgacattctgttcaaaaatcgcatgtccgccctcatgaatcgcagaaaacatggcgctgagcggctccgtctcatagtagtggttcgtcacacgcacatcctttgaagaaaaattcgtcgtaaacggatgctccgtctccccgaccgctcccgcatccctgcggaatccgatgtaatcaagcagcagccactgtaccctgcgctgtgcgtccggatcagcataggcatgaaatgtcggattttccggcattttctttgcagtaatctgctctactaacggtatcagttccgtcttcacttcctcaaacagccggtcgatcgttgcctgatccatgccctcctcacactgttccagaagtgcgtcatacacatcctttcccggatctgtatagccgattacctgcttcgtcatctcaatcatattccggaggtgcggtgcataaatggaaaagtccgatgcattttttgcttcttcccatgcatttccggattccgccgctgcccgcacaaacgcctcatataaatccgccggtattcttttattgcggtcgtaatcgcgcttcatgcgttttacaatgaatctccatgtgtcatctaacgcatcatattccgcaggctgcgccagtttctccagaaattctcccagtttctccgatgtccccatctcaaagctcttcgtggaaaaataggtcagcgcatccacatgcgccgcctgcccaagcttcggcactgtcgtctgcatatcccactgcaataatcctgtcacatgatcatactgattcatttcttttaaatattctttaaattcttctaataatctactcatcttatctcctgattttttctttattccgccggcataccgtcaatgatttatcgcggattccttctcctgaccgttgctttcccatacaccttcagccgctctttgacgcatactttccatgtctgcgggtcttaccctgcgaacctgccagcactcgttttgtcacgctgattttgagttccggcaaaagtccataaacagctgctttctgcacatccatatctcgacgatgctcttctgcacatccgatattccgtggaacttccgggaggcatccgctaggattcattttcccttgtttctgcactgctttctgtgcatccaatgttccgtggaacttccgggaggcatctgtcagcattcattttatcatatcttacatagactgtcacgaattatgtcgggtgacgaaaagccaggggagatgagactggcggggatggaaatctgatagaatcctgagcctcacaggtctgggagtatatttttttctctccagacccgtttttcttccttaagcgggtctgggcgcgtatttttctttccctagacccgttttccggacttgactgttcaaaatgattgacataatttcaatccccgggtctaattgcttgttttcacattccctagacctggttttcttccttgggcgggtctggaagcgtatttttctctccccagaccctgtttccgggcttgactatccaaaatggttgacataatttccatttcccgggtctagctgcttattttcacatctacagacccggtgtcgcacaaaaacatttcaaataagttaacataattccaactcatgggtctgagcgcaccttttctccactccagacccgcaaaacatctttagcactgtttctaaagcatatcccacaaaaatatagctttcttctaatattatagcttccttctaacccgcaaaaatgatacgataagagcgcaacccattgatttttctgacatttagcacaggtctgccgcactaccgcaccggcagccagaaaggcggttccattgaaacattttctccgattgaccgactataccaaagctgacatttacgaaatcttccatatcaccgatgagatcctggaggggcactatcagaatctgctgcagggcaaaagcgtcgttttatttttcccggaatccagcatccgcacaagggtcacgtttgagaagggcatcgcgcttttgggcggtcagccgattttgtttccaagttccgctctcgacaaaaaggaagatttgcaagacgtcatcggctacctcaacaactgggccaatctgcttgtcgtccgccaccgggatatggccgctttggaaaaaatcgctgcatctgcatccgtacctgtcatcaatgcgctgaccgacgcaaatcatccctgcgaaatggctgcagatctgtatgcgctctcaaaaatacggaatgattttaccatggaccactttctgttctgcggtgtcacaggaaatatcgggctggcttggaaggaagcctccgaagtgatgggcttttcgctggagcagtgctgtattccgggatatgagatgaatggcgtgccctcacatcactgcatccgcgacgccatccgtggaaaagacatcatctgcaccgactcactgccggccgaccttctttccgcctcccgcggctgcaccgtcgatcttgctgccatgaagctggcaaacgagggtgccatcttaaatccctgcccgcctttttaccgcggcgaggaagtctcaaacgacgtcatcgactccgactattttgtcggatatgaatttaaaaagcacctgctcaccgtccagcaggcaatcatggtgtactgcttaacacactaaacttttcatataatgcattaagcttttcattttttgacataacacaatatttcctgcaagaaagaatcctgttttgcaggattctccgcctgcggcgggttgctctagcgacataattccactccaacgcagtgcaatcctgcccggagaactttttcattcataggacgtaatttcctatgaatcaaaaaaactcccgtgcgcgtgatacctctcttttccacagcactctgtagaaaataccggcatcccacgaacggaagcttcctgtttctttctattctactttacctcgtcgatcgcacgtccgatgtcatggcgcatgtacttattcgcaaaatcaacccactctgtcgcctcgtatgcttttgcgcgcgcctcctttaaatcttttccggtcgccgtaatgccgagcacacgcccgccgttcgtgacgatcgtgccgttctcatcgaacttcgttccggcatggaagcagaaataatcgtcctttccgtcgaacttttcaagtcctgtgatcggaaatcccttctcataggacaccggataaccgtcggatgcaagcaccacacataccgccgcattgtcttcaaactgaaggtcgatcgtatccagctttccatcgacgcatgcctccatcacatcaatgatgtcattcttcatgcgtgggagcaccacctgtgcctccggatcaccaaaacgcgcattgtactcaagcaccttcggtccgtcctccgtcagcatcagaccgaagaaaataacgccggtaaacggtcttccctccgccgccatcgcatccacagtcgcctgatagatgtgcttttggcagaactcgtccacttcctttgtgtagaacgggctcggggaaaaattgcccatgccgccggtgttgagaccctgatcgccgtcctttgcacgcttgtgatcctgcgcagaggacataatcttgatcgtctttccgtccacgtaggaaagcaccgatacctcgcgtccggtcatgaactcctccacaaccatcgtgtttcccgcggagccgaacttcttgtcctccatgatctccttaacacccgcctttgcctcctcgagcgtattgcagatcaaaacaccctttccgagcgccagtccgtccgccttcaatacgatcggcatcttcaccgtctccagataagtaagcgcatcctctgcagatgtgaaattctcgtaggcagccgtcggaatgtgatattttttcatcagatccttggaaaatgccttggagccttcaaggatcgccgcattcttccgcggtccgaatacctttaagccctccgcctcaaacacatccacaattccgccaacgagcggatcatccatgccgacaattgtaaaatcaactgcatgctccttcgcgaacgccaccagtttgtcgaactccatcgctccgatcgcaacacactctgcaagcgatgcaattcctgcgtttcccggcgcacagtagatcttatccacgcgcgggctctttgccacactcgtcacgatcgcatgctcacgtccgccgcttccaactaccaataccttcatatccgcttcctcctgcactctgtaactcatacgcttatttctcaactgtcacatgtccgtttgcaacagacactctgccgtttgcaatcagatcgatcgcctgcggaagaatgatccactctgcctgctccatcacacggcgctgtaaaatctccggggtatctccctcttcgaccgccaccggcttctgcaaaatgatcggtcctgtatccgttccctcatccacaaaatgaaccgttgcacccgtaactttcacgccgcgcgcaagcgctccctcatgtactttcaagccgtaaaagcctttgccgcagaaagacgggatcagtgacggatgaatattgatgatccggttgcggtactgcgcgatcatctgctccggaattacaacgagaaatcctgccaacaccaccagatccacctgatagctgtcaagcatcgccagaaacgcttcattgaatgcctcacggctctcataatccttcggtgaaatgcaaagcgcctcaatgccgtgccctttcgcacgctccaacgcatacgcccctggattgttgctgatcacaacgtctacccgggcgttcgtgattctgccctcatcgatggcgtctaagattgcctgcagattcgtgccgcctccggacaccagtaccgctacttttagcataaggttactcctttttcaccatccttgatctcgccgacaatatacggtgtgtctcctgctgccttcattgccgcgatcgtcttgtccacgtccgccggatccactgccacgatcatgccgatacccatattgtaggtattgtacatcatctgctcctcgactttgccctcgcgcgccatcatctgaaagatcgccggaacttcatagctgtccttccggataaccgcatgctttccttccggaagcatacgcgggatattctcatagaaaccaccgcctgtgatatggctgcatgcttttacgcggacgcccgcttccttcacctcacggagtgccttcacgtaaattctggtcggagctaaaagcgcctcgccaagtgttttgccaagctcctcatgataggtatttaacgtatccgcatccatggagaaaatctttctcaccagagagaatccgttggaatgaacgccggagcttgccataccgatcaaaacatcgcccgccgcaagatcagctcccgtaataatgtccttttcatccacgataccaacggaaaaaccggccagatcgtactcattctccggcatcagccccggatgttctgccgtctcaccgccgatcaacgcacagcctgcctgcttgcagccctccgccacaccggacacgatcgtcgcaatcttctccggatagttcttgccacaggcaatatagtcaaggaaaaacagcggctcgccgccggcacatgcgatatcgtttacacacatggcaacacagtcaataccgatcgtgtcatgcttgtccagtaaaaatgccagttttaccttcgttccgcagccgtctgtgccggatactaacgtaggcttctccatattcttaaagctctccatggagaacgcaccggaaaatccgccaagtccgccaagcacctccgggcgcatggttcccttcacatactttttcatgagttctacagacttgtatcctgcctcgatatccacaccggaattcttgtaatccatcctattttcctcctatatgcttgtctgttgtctatccaacgcaacacgggcgactttttgcaaaatcatccgttcctgttcctagtaattctgatatcccacttcctgcagtctggcatccttcgcctgcacctgctcttttaattctttggaatattcttttaatttttgcaaaattgcatcatctgatgttgccagaatctttgctgcaagtaatcctgcatttgcaccaccgttgatcgccactgtggcaaccggaatgccggacggcatctgtacgatggagtacagggagtcgcgtccgccgagggacgtggtgtgcatcgggataccgatgaccggcatcgggaagatcgccgcgcacattcccggaagatgcgccgccatgcccgcgcctgcgataatgaccttaaagcccttcacctctgcgctctttgcatactcgaaaaatacatccggctcacggtgtgccgagataatcgtcatctcatagtcaattccaagcttctctaaaatgtcggcagcctttgccattaccggcatatcggaatcactgcccatcacaatacctacttttgccatattgctcctcatttctgcgcacattctgccataccgggttcgtgccgggtgcgccggggcacgaatcctgcgcgcggaaccgaatccttcccatgcgccagtttctcaatctgctcttagtatagcgtccacgcatttagaagtccaattaacactttttatgtgatttataaatacagctaatataagtatctatcccgcccggctcaccttcctacctgtccagcggtccgttcaacgcctccgttccggcaagcacaaaacgtccgtccgcgatgatatcctctgtcgtaccgtccttccggatcacagtgatcttatccagctcgtcgtacggaatcgtaatatcggtgtggcagtttaaatatgccttttccggattctcgcggcgctgcgccgataccgtattctcccgcgctacaatcgcttttccatccggattgtaagagaggttgtcctcctcatggctgtagcaggtgtcccccaccgcaaagtgcgggccggtcttctccgcaatcagaatcggcagtttgtccgcaatgtcatagtcgcgcgccatccggtatgccgtcgtgttcgtgccgattgcaaattctcccatcggcagcgtctcatggtgcatcagcacattgtcgcggatatagtttttgttctccgcctcatcctcgaaattggtgcaggtgtatttttccaccatgccgtccttaaaatcgatctccagattcttgtaattcagaccgttcagatatacctgtccgacatgcagctttccgttcgttccctcaagcaccggcgatgtaaacacctcgcccaccggaatattcacgtccgccacacagttctcaaatgcggtctccccttcgggattccgaagcttccagatgttgacatataagtcggtcttattggctccttttccggtgatgtgcacacggtccgcctgatcgagcacgtcgatcatcttctgctgcatgttgcggtagagcatgtaatccagcgtattgatcttcaccgtctccgcgaaaatctcctcaaagcgggcgccgatcgacggaagcgggtaggcaatgatcgtaaaactgcgctcctcccccttgatgtactggttcgtgatctgtccgcgctggctcatctcatacacacagagctgctgctgtttttcaccgtaacggaatgcctctttttttgtctccggagaaaaaggttcttctccgaacacctcaatcaccgccggccccgccatgccgttcgcatgtactttttcttcctcaaatgcgtttttccacgtctcgagtccgcgctccacgtacgccttgtcaagatagtacgcgcgatcctccctgtgatcgtagtcatactgcttgttggctgccgttcccgaagccagcatggtcacttcgagtcccattttttcaaaattgcacactgctgcacgcaccatacgctcgaagccaatcggataccgtacctgcgccgccgtctttttggacagatccttgcccgtcgtctcaaaaccgatccggtagccttccgtgtatgtgtccgccatcgcctggatatccgcctccggcagtgtatttaagtaagcggcaatctgtctctcattctccccgatataagcgccgtagcggtaaagataacgcagatccgacagatccgcctgcatcacgatctccttttcaaaatcctccgcaggattcacaagacgccgcaccgaccgctcgtcaaaaatctcccgataatcatgaaaataccagtacaaaatctgctgcacttctttttcctgcggcagggcatctgctgctgcgccttcaaagcagttgtagacctccacaaacagctccatcgcgatcgtaagctgcatcagatttccgcggaaaacctccccgcatgccgtccgaagatgtgccgcaagaagcgagagcgctccgccgaacgtctctcccagacgtgcagcggcgtaggccggattcgcatagctgtgcccgtaggcttccggcaggatctccccgtagagcgcctcattgtccgcctcacattcctccatgctccgcgccgcaagactgccgctttttcctttttcatacagtgcacgaaggctctgtaaatatccggcatttgtccggaaatactccgcaaacggctccggcgcctgcgccgcctctgcaatctctgcaatccgttccgctaccagttcatagcgctccgccgccagttcatttgtctccttgtaacattcctgatatcccaaatcaattcctcctcacaaacaataaatcccgcgccattgcgggatttgtattaccttatgaaaacgtcagccatgcctgaacacaaatccatccggattacggctgaagacgtcctttttttacattttcctcaatgagcgactttgcatacgcccacagttcctcggatccctcatgtgttctgctgttgcgcgcaagcacctgagactccctgacgccgtgctccacccaggatttgccgttcgaagcattgttcagaagaagcggctgtaccttgtccagcatattggcgaacttcgcctccaccgtctccatcgcctcaaactcatcccacagaccgcgatattccatgcgctgtgcatccggaagcagcccgaaaatacggtccgccgccttcaactcgcgctcccgcttggtcttattgccttcggtatcgtatgcgtaggtgtccccggcgtcgatctcaatcacatcgtgaagcagcaccatcttcatcgtctttagcacatcaatcttctcgttcgcataatctgcaaacacaaacgccatcaacgccagatgccaggaatgttccgcatcattttccttgcggcttccatccgacagataggtctgtcttgttatcttttttatcttatccagctccatgataaaagccatctgtttctcaaaatccgtcatattcttctcctatgccaaaaagccgatcacgtacagcgccacccagattccggtaatcagaagcgagcagagcgtcgaaagatacgggaacagcttaaaagagttctcctccccaaggctcttcaccgccagaacgagcgcacagatgccgatcagcatcgatgtcactcccgcacttcccagatacatgctcccgttgccgcggctgtcaaaagaactgaccaccgccgcaaccagtatcccgatggaaataatcgacaaaaaaagtgctgccacacccctctttgagtgtgtcttctctgtaaatctgtatccgtttctatgtcgtctcgccactttcttttcctctctgatttctctgatgataataacgcacaaacaggcgatataggccgtaacccgccataccgcccagcgtatttaacaggagatcgtccacatcaaagcttccgactcgaaagacaagctgcagcagttctaccagaagactcagttcaaaactgtaaaatgccgtccgccagaattttttacacctgcctgaaaaaacgggcagaaaaaatccaaacggcagaaacgccgccacatttcccaaaatattgagcagtacggctttcatgccgaggactctccagtattttacaaaacgcgcgatctcctttaacggaaccagattgtaatgatatgcccgctcgctgtaggtgcgccccatcttctccgaaaagaacagaaaataaaacagcaccacaaaataaatcagaaataaaattcctgctgcaagacgatgttttcttctagttgcagccatactgcttatagtagtcgtcaatggcagccttgatggtatcgtcaatcacaacacgtccctggcatgtgcggttgtacagatgctctaccacctcttccatggtaacgatcgcattcgtctcaaatccatacttttcgcggatctcctccaatgcgctcttctcgccgccaagccccttttccatgcggtttaaggataccatcagccccacgatcgtgacatctgccgctcctctcaccttcggaaccgtctcctccatggatttgcctgaagtcgtgacgtcctcaatcatgaccacacggtcaccgtcttttaacttactgccgaggaagcttcccttatctgccccgtgatccttctcctccttgcggtcagagcagtagcgcacctccttgccatacagattgtgaaacgccaccgcagtcacaacgctgatcggaattcccttgtatgccggtccaaacagcacatcaaaatcatccccataggtctcatgaatcgctctggcataatactcgcccagacgcatcagctgggatccggtcacataagcccccgcattcataaaaaacggggatttcctgccgctttttaaggtaaactccccgaacttgagcacatcgctctccaccataaattcaataaactcctgcttgtactgctccattctatctatatcctcctgttatcctaagccgtcttttgttttcgttctattctactctaccataaaaaaaggagaaccgcaatgcgtcccggtagctttcggccttcctgttggcgtaaaaatattagcagactccatcataatgtgtccacattctaattattttcacggttccatcatacctcatccctttccattccactggctcactatacacctgataaaccagcctgtgctgaatattgattcttcgcgaataaactccctgcaaatttccaaccagcgcttcatagggtggtggattttgaaaaggggtttcccggatgacctctatcagctttttcgccttatcatcaagtctggcactcttcaaattcttaatatcttttactgcctgcttatcatatacaattctgtacatagatctaccattctacatcttcctctggcacacaatcttctaaccgcgtatccatcccgcttcttatggattcaaccatacctggaattgcgttcaaatatatcgtttcctgaattgcattccaatcattctcggaaacaagaaccgcatttccttttttgcttacaattaaagccggttcgctgtagcgattaacgtcttctaccagactgtagagttcctttcttgcatttgttatattgattgccgacataataaatctcccttttgcttgtagtgtaatttctatatttttttgttattttgtcatttgaaaatctcttgttccattctcgtacattcttgttcttcattttagttacatcaaatccgatgtagttgccttatgttcttttatgcttatgaatgtcgagatttttatgtcatagttattatagcgtacgtcattgcgtacgtcaagttgctattttattctatgcacaagtcacacaaatttttcccataagcaaataaaatatccagaatcccaaagtcagacttgtcttttccaactccggtttctggatatcttctgttcctccgatatacgcttataacttctccgcttctcttccgtatacttcaatctgcgtcagcgcagggaacggcgacgggtcgtccgcttttttcagcttttccaaggtcagttctgtgataacccgctcctcgaatacgatctcgtgcggcttttcgcttttttccagctctgccacgacctcgcttccatccgagaaccggatcgtcacctgcttccaccagttatcgtgcgggaaatccgcccttgtgtacagacggatgcggctgaccaccacctttctgccgaattccagcctcatattcgcatcctcgcgtcggttgattccccacgattcatacggccattctccgtgcgcatcattcaccgtgacgccgtcgatcgcgtttctggcggcgaacaccgcctccccgcgcgtctccacattcgccgatgcatgcggataacagttggtctccccatgctggtccatcacattttttgcaagattcctgcaggagccgaagcatgtcatatccgcaagctttgcggtgattaaatgccggttcccggaaaatgtcttgggcgagtaggaaatctttctctccccgaacggaatcctgtagtggacgtccccggtcacatagacggttgccgccccgagcgcatcgtccgccatcagttcgtagaaggcatttttcggggagatctcaaagataatctcatccccctcctcgtattctttcgtgtagaccagtgccgcctcatcctctcctctggcaacacttagggtcatgccgtccttattctgtatcttaatcgttatcactgccatctttcccctcatctctccattcatactgtgaaaaaacaaacgtcaggatcttcgcgtgtacatatgcgattccgccggccgacacaaaaagcagcggccagaacacaaacaacgccgccgtgataaacagtgccgcggatgtcagcatcagaaatgtccagccgaagttcttaaacgacatcacaaacgcaagcgcaagcgtcttctttaaatccgcgtccgtccatgccagcagtggaaacacatacagggcaacgaagacaaaaatcaccgacagcaccagaaaaatccagaaaaacaccgttccgacgccgcctgcgaggtgataataaaaatataaatccgctccgaaaaagattccgagcgccagcattccgatccaggcgatcgtcgcagatttaaaattctccttaaacgcccgcacaaaatcttcccggatgtagccctccttgttggacgctaacgtcatggaacaatagcagagtgcgcacgtcgacgccccgattgttacgaccggcagtgaaaaaagcagccacagacatgtcagaaaaaacatatccgtcacctttcccataaaacgccagaccggattgtccatatcaaacatttttcccatcgtctttcctccctgtctcttcctgcgaaatcatcgctttgtattcctctgccgaaaacgcggctgccaccccggtgttctcctcaaagatccaccggagcatcccgaccgcctgctccttcctctctgatccgctcacaatcccgatcaccgggtctaagagcgtaatcccgtactgcttcacaaacgcggtatctgtcagtgtgatgccgcatgccacaccgtttttttcatagatgcgcgcccccagcgcttcacatgccccagcgcccagcagttccccaagatcagcaaacgcattcaggttacagtaatagtcaaacacatctttttccagaatcatgaagtcgagctcgtgcgcatacacgtacgtcgtgatcgttgcgagggaatcctgcgtattggcatcggcgatcggcgtctgccccagcgcggctgcatccatggtaagcgctgtgtccacgacgacctcctccccgttaggatcgcccccgatcccggcgaggatcgcctcctccatctgggttgtcaccgcatcgtcctgcacattgttgaccacttctcccatgagaatctgtgtcttttcttttttccccatggtgtccgcaacatagaggaccgctgccgcgagaaccactgcaaaaattacgacacctttataataagtccaccaatgctccagtttctttcgcaccgcgcatcctcctttttgcttctctcctaccagttcagaacgtcgcccaccagcacatcctcggccttgtcaaagacaatcacatttccgtagcccatacagccgtctgcctccacgaggtcggtcggcgaattgacctcctgatggcagaggatcaccacatattccttttcgcctgtggtgatctttaatgcctccgccatcgtctccggatagtctgtctgctttaatgccgagcgcaccggaagcttctcaatcgaaagcgggcgtcccggatgtgcatcgatgaccgtgataaggctggtaaaaccgtcccccggctttgtcaccttacacaccgtattttcctcttccacattgtaatgtcttgcaatgtggccgcgcttaagctctgctttcacctgcgccgacacaaaataaaaatccgcttctgccattttaccacgataggccacgcatgggaacttcttttctcccggcgcagtcaacgtcaccgcaccatgattgttaaaatgaaaatactgctggtaggtgtgacagtccccggtgtacatctcatccaccagaatatacaggtcaggctttatgtaaaccaccttccggttcacatagacgccgcccggaagatccatgtagccgagctgccccgcctgtgcaaattccgccagctttgtgcaccggaaattctctttgaccggctgggaaagcttcgagcactcccaggaatccttgcagacggtaaacggcagatcatccaccgtgatcgtattgtgtcctgacggatccttgtacgaaaaacgctttggtcctgaaacgtaggtatatctaccaccgtccatcagcacatcctcgccgtttacaaccaggtcgatgtgcagcttatcggaatgtccgtgccccgctcccatcgtcccggaatgcagatgcaggaaattggcgcgttctgaccagtccgaccggaaataagtgttcccgctgtgttccagaaacagcgatgtaaagtccggttttctgcgctccatcaccgcatattcttccccggctttcatgccgagatcccagatactttcataatcaagacggtcgaatccgccaaaccgcagcaccggatttaaaaacagatacgccgccacgctgatgcggtcccgcacatccacgtcgtcgctgtcccccatcatcacgatgtggtgatccggctttaaccacgcgacatccgccattgccatcttctccgtctggcgcaggatcacgtccggcagtgcaatgccgttccgctttgccagaaggatcacgtctaacaggcagtgcagcacctcgttgtgatacatcggcgactgctcccagtgcacgccgtccggcatgatctgcatccgcacctgcacctcaagattcttcacggcaaacgcgataaactgctttgtcttctcgctctgcgggagacacacgccgatctcaaacagcccgtgattctcaatgacgccccagttactcatatagcggtaagcggaatgacattccatgatgtgttccgcctgcaggatcatgctgtcataatatttctgtaaaaacgcttccgtgagcgtcgggctgtcatgaaacagccagatcgccttgctccagtattccccgcgaaagccggtgtctagacttctccacggtcccgccgcatacttctcgttcagcgggacatgatcgatccagtcctccgcaatctccataaacgctctcgcatatttctcatccccggtcatctgatacgcctgaccgagcgtcatgaaaaagcggtgtctgttgaactgccagacaaattccggatcgtctgccggcatatacgtccagtcgatcgctccgtcaaactgtaccggctcgtcggtctgctccagatcccacttggagttgaacagaaaatatttccggcacacaccgtccgccaccgcaagcgtctgcgcgacatcttctggaaattgctccctgcagtacgccccgaccgcttttccatcctcacagtaatagtgtgatgcatccctgtcaaaaaatgcttctcttttcatcctgccataccttcctttttcccttgttaccaatacggattccagtcttttttcagccgcatgagcgcttccatgtaaaaatagtctccccagatattgcactcgtccaccccgtaatgattgcaggtattatacggagagtggttggaataggtgctgtgtaacaccaacccgttcgactcttttggatctttcaccgcgtatccgtcgtacaacgccttcatcaaccgttttgccgttgcacggtaagcttctgcctcgtccggctttagatattttgccatctcaagcattccgcatgctgcgatcgacgccgaggaggaatctctcggctgatcgtccccgtccgtgaactccagatcccagaacggcaccatatccttgggcagatgcgccaggaaaaagtccgtgacatcccggaacttctgaatgtattcttccctttccgtgtacttgtaggcgagcgccatcccgtagatgccccatgcctggcctctcgcccacgccgaaccgtcgcggtatccctgacaggtggctccgtgatccggtgcccccgtcttcatatcgaagaaaaaggtgtgccaggtggaatgatcctcacggatcacattggcgaccgccgtgtgaatatgcttctccgcaatgtcccgatacttcggatcgccggtctcctccgacgcccagtagagcagcggcagatttaaaagacagtcgatgatcagccggtagttttccggtgcatccatcgcaccccacgcctgtataaaattgcccaccgggtgaaatctgcggatgagctgatcggctgccagtatggctgcctttcttcccgtctcattcccggtcagtttatagcccgccacgcaggacggcgaatacaaaaatcccatatcgtggtgatcgacttcgatcttgttttcaatgcggttcaaaaagctgtcaatctggatttcaccggcttttttatagatgtctttcccggtatcctcgtaggacagccagatctcgcccgtccagaatcccgtcgtccagtccacattgtccgtcggcgcgtaaaacccgttctcgctgtaagccttctggaacttcgtcgtgaactccggcagattgcgctttacctgcgccgtggagaaatccatcgcctctctgatctcctgctctgtgatctgcggtttttcttcgtatcgcatacccttcttctccttttccgttttcaaatcatgttatgtttatccaacacgttattcctgtagagtaaaacaaagccgtcacacaaacgatctctttttgtgtgacagctttgttacataccttcggtcttagccctttaaaccggtagatgcaattccctctacaaagtatctctgcagacagataaatacgatgagtaccggaatcagggaaagtaccgagcctgccataatcagtccgtactgggaggaatactgaccgatgaacattttgagacctaactgaatggtcttcttctcctgggattttaagtaaatcaatggtccgaggtagtcattccacgttgccacgaaagtgaagattgtcagcgtggacagcgccggttttgacagcggaagcatgatgtgcgaataaattttgtattcactcatgccgtcgactctcgccgcctcacacagttcgttcggaataccgtcatagaactgtctcatcatgaacacgccgaatgcggaaaatgcctgcagacagatcattgcgagcagcttatcgttcaatcccatcttacgcatcatgataaactgcggaaccatgtatacctgccacggcatagcgatggtcgcaatgtatgccatgaacagtacattcttatgcttgaactccagttttgcaaaagagtatgctgcaaagctgcttgtcaaaagctgtaaggcggtcaccacgattgtgaggaacacggtgttcttcacgaacgtgccaaacggaatcttcgtccagatatccacgtaattgctccagcgcggtgtctccggaatcagaacaaacggcgtcatctggaatacttcacggtctgtcttaatggaagcggacagcatccagataaacgggatcaacattgccgccgtgataatcagtaaaatcagatacaggaagaacttcttgatcagattgtttcgtttcatcgatgtttcttttttctgctttgtcattatctctctcatctctgttctccccctttctagtcctctaacttcttctcatatgcaaactgtataatcgttacagcaagtaccagtacaaacagtaccattgcgaccgcactcgcataaccgagtttccagtagtcgaatgcattttcgtaaatgtagtaaacaagtacggatgcggagttgcttaacttgccctggcttccgcctgccagcatgatggcgatgtcgtacaccttaaagcagttgatcgtcagcatcacgacaacgaaaaaggtggtggatcgcagctgcggccaggtgatatatttaaatttctgccaggtcgtcgccccgtcgaggcttcccgcctcgtataattccgacgagattccctgcagtcccgcaaggtagattaccatgtagtaacccatatatttccagacactgaataaaataagtgtcagcataatcagatttccgctaaaccagttcggcagattcttctgctcgatcccgcagattgtcatcaaaagataattcaccggtcccttggtcggatgaaaaatcatggaccataccgttgtgatggcaacgagggatgctacatacgggaagaacgataccgttctaaaaaaacctcttcccttcaccttctggtttaagacaattgccagtgccagcgacacaaccatggtaagcggtaccgtgccgacacagtagataatcgtgttttttaaggatgccgtgaaaaaagtatccgacggcagtttcaagaaattggaaagtccgacaaactgaatcgggttgtttccatcccattccgtaaatgccagaataaaggcaaatatgatcgggatcaatgtaaatacggcgaatccgatgaagttcggcgcaatgaaagaataggcaaccagatcgtctctggtctgctttgacagtttgcggccgcttcgcattgcagcagccttccactgcagtttgtttctgttttgaatcagtttctgttttttcttgttatcagtttcgttctgactttgttcccacagtcttgccatttcggcttccatctgctctaattttgctgctttcttcttatccataaccatgcccaaaagccagatacggcttatttcctttctcctttaagctgtttcatttttaagggccggctgttttcagccagcccttttatcagcagtcgtggttatgcttccgttccattactggttcagaatctttccaacctgctcattcatggatgctacaccctcttctacggtcacttcacggttcatgatggaagtgtggtaggtgtcgaggatactgttgatctctgatacgttctcagcatacggtacctcaaggtatgcatttgtgatatttaatgcttccttgctgccctcgtctgtcgggaatcctgccatgccggcgattgtgttgatgacatcgtccgtcataattgccgggaagttaccggtggaagccattacctttgcgccctctgtaccggatacccagtttacgaaatcaaatgctgcgtccttgtttgcggaagcgcttgtcactgcaagacctgtgatcgtagcgatcgtgctgcctgcctctgctccgtccggatgcggatagcttgcgataccccagttgccgcagagagagctgtcgtactcaccgctgtcaagattggagatcaatgtggagatgaaccaggaacccatgttcatcatagcaacatttccgttggagaatgctgcggagtagtgaagaccttctgtgcttaagtctgtgtaggtctggcatacaccgtcatcctcttcacttaagatcatgtcatagtacggaatcatccagtcgtaattgccgtccaggatagagtgttttccatccaggattccgaacagttcgactgcggatctccatgtgtgataatggcatccgtatacctgggaaccgtaggtggtatctgtcagctgtcttgccagtgcatcgtaatcttccatcgtcatatcgttggacggataagcaatgcctgctgcatcaaatacatctttgttgtagtagatcagccagtaatcgcttctgaacggaagttcatataagcttccatctactgttacctgatctgtgattccgttgaagtctgcgaggttaattcctgcatctgtgatgtaatcatccagggactccagcgtgttcttctgaaccagcgttgcgtaacccggtacatccttgatcgtaaccacatcgaagtccgatccgcttccggataactccgttgcaaggacagtcatgtaatcggttgatccaaggtctaccatctcaatggtgacgtttggatttgcagcctcatatgcctccttgagtgcgttccagtaaggagtggtctcctgatcccagattgcccatttgagagtgactgcctctccatctgtcgcagccgcatctgctgctgtctcagtgcctgccgcagcggtgtttgtgtctgctgccgcatctgctgatgcatccgttgaagctgtttccccagagccacaacctgcaagtaacgcccctgtcatgcttgctacaagaagcatgctcaatactctttttttcatctgaatcctccttttcgtatctctatcgttctccgataagatgattttattatattggctttgccatacaatggacatagatttttttacgtttaaattcacatttttttcctctttctgttttcgtctgcattttttcttcccaaacctgtcttttttctcaaaacctgtctttttttcttcactttgcttttcgctctcccaaaatggatttttttctttccgaattttctttttgtgtctataatataaggtatgaagaaaaaatttacgacgattcgatcccgaattacactgactacgattacactctgtattttcttaagtatcgctgtgtcctatatcagctattctttctattataaaagtgtaaaacaaaatatgatccgcaccgcggagtcctctctgacactgctcggctcctccattgacagcaacatccaggatgcttattctttcgtccgcaactgtcaggcgaactcttttatcctgaattatctgtcgtcacagggttcccagagtgcgcgtatcaccgcctctacttatctgaagggaagctacaacagttacgatggccgctactatatcaagcgcatttttattgcctcctacaagaaccgggattttatccaggctcttgcttccaccaacaaccagcccttccactcggcagatgatatccgggatctctatttttttgacagctactacagcagcccttcctattcttatagcgaaggtatcctgacaaccgacggcggttcacagtatcttccgatcatccggccgctttacagccagtataattccgacgagctcggttttatctacatcgaaatgtcgccgaacgtcgtcaccataccgcttaagaccgccggaacctaccagaacaacgacttttacctgacgttggaagatcacagctatgtgtacagcaattacaccctgacggacgccaacccttcctatgagattacgggagatctctcctccattgcatctttctccgatacgatcgtaaaggagatttcaaatgccaacggaaagttcgtctccatctcggttccgctcgccgcggaacactgctatatcacgcagctgatcacggtcaatacgttttacggacagcttgcatccatcattttcgtcatcgtggcgtgcgccgtcattaccggtatcattcttcacacgatttttaatcatatgatcaatcatccggtacaggaactgcaggtccgaatgaagcacatttccgagggaaatttcgagcgcgactcctcgatcgagtggcagcatgagctcggcgacatcggcagaagcatcaacgatctcgccgaagatgtgaaaacactgatggatcaacggatccgcgatgaaaatgagaagcgtgagtacgagtacaaaatgctgcagagccagatcaatccgcattttctctacaacacgctcaattccatcaaatggatggcaacgatccagaatgcgcctggcatcgcggagatgacgacggcactctccagacttttaaaaaacatcgcaaagggaacagagaaggcggttccgctctctgcagaactctcccttctggatgattattttacgattcagaaataccgttatggaggaaccatctccttagaatacaggatcgatgacgaggcggcattaagctgtctgattccgcgcttcaccttacagccggtcgtggaaaattctatctttcatggcattgagccaaagggaacacccggaacgatcactattcacattttccggaaaaatgacgcgattcttcagatcgacattaccgacgacggcgtcggcatgacggaagaacaggcaagacagcttttgtccgagaacaagaacgaaaagactgaatttttcagggaaatcggcgtcagcaacgtgcacaagcggctgcagtatgaattcggcgaagattacggcctgcgtgtggaaagccggctttccgaatttaccactgtgtccgtcctgcttccgtttgcgccgcaggaagacatcggctaaatgcagacagatatttttacaacaaagaaatggggttacagttatggtacagcttcttatcgtggatgacgaaccgctggttcagatcggcatccgctccatgttaaactgggagagcatgggaattgaaattgcaggcactgccacaaacggcaggcaggcatatgatatcattctggaaaagcatccggaaattgtaattacagacatcaaaatgccgattatggacggcatgcagctgatcgagaaatgtcagtcccaagagcatccgcctctttttattctcttaaccagctatgaggaatttgctctggtaaaacaggcgatctcctaccaggtgctggattatctggtaaagctcgagctgacggaagatgtgttaaacgctgccatccagaaggctctcggcattctggaaaaagagagaaaacaggcagccatcccggaaaccggttccgatctctccttattgcaggataatttttatatccggctgcttctaaatctattcgagacagaggaacaatttgcgacacagtgcgatcttctgtccgtccgcttcactgccgccggctacacggtggcgtatctggaaatgcagaataccaggcagagtgcgtccgctgtcgcatcgtcggacatcacactctaccgcagcagctaccagatgatccggaatctgatcgtcaaatatgtgccatgccggattctgttccttgacacgacacaccttgcgattattttttccctgaccaaagaacagacgggcagctatcatcagcttctgaccgatgcactcacacagacaggcgacatgctctacaattattacagcataaggattcttgcatcggtcggctctctcgtcgaaaatccgagagatctgtccgcctcctattcggacgccagacagattttcccggacgtccgccagagtgattctgccgttatctttgccgacgagggcaatcccgcccgcgaggagcacaacgtcttcaacattgccatctttaaggatgagctgcagaaagcgttcaacgaatacgatccggaagcactctccgcagtcttccacgacatcattgacctgttttccaatgataagagacattactcccaggccttatccgccgcgagcaacgtgctgcacttaaccctctcctgcctgagcaacggggaagaacagttaaaccagatctttggtgaatccgccaacgggtacaactgcctctacgaggcggaaacggtgccgcaggtgctctcctggatgaccgtgctgtgcgacggtctgtgccgcctgttttccgagcacaacaaggattacaagaaccgcaccatctccgcggtcaaaaaatatatcaatgaacacgttgacgagaagattacgttgaatcagctctccgatgtcttcaacatcagcccgaattatctgtcgatcctgttttccaagtacaacgatatgggatttatagattacgtaaaccacgcaaagattgaatgtgccaaggaaatgctggatgagggaacgctcaagatctatgagatctccgacaaactggggtacgagagcgcgttctatttcagccgggtattcaaaaaggtggagggcgtgtcgccgcgcgactatatcaaccggacttgaggcacttctttcttttgcccgtgttaaatgttataccatttaatctcgtttgcctccatctccagaggaaaactgctgccatcaccacgataaaccacagttttctggtgggcatatgtattgttgaccacgcagaacctgccatttttcacataggcatgtacttccacattgaagttggaactgaaccactgatgcagatccttctctccgtgggtactccacagaatactgcggtacagaatacggctgttctcaaagctgtaaggcagaccgctgatataaacacagcgcccctttccaaactcatggacagccatctgcacttccttctcccgctgtaccagaatttccgtgtcctcgtaagcgaagatgttctttttaccctcaccaaagtccactggcttcgtggtatctgccagaatgaagtgatcgggatgctcctcccagttatatttatcgtagtttaaagtaaatccggtttctttttccacgccgagcatatctgcaagctgcaggtaatgcccctgaaactgatgaccagacggctcaccgacaccgataaaacctccgccgttatatacaaactcacggatagctgcggaaatggcaggattctcccagatgccgccaccggtatgagcagtatccccatctcccacattgataatcacatccagatctttaagaatttccggatttgccagaatatcatcaaaggaaataaatcgcacatcgaaaggggcaccacttaatgcttcaataattcccgcatagctgtaattctgtttctggtatagggcatggtgtaccatatggcatccccagcttctaattttaccccagctgttcaacacagctactttcctcacgcaataaggaatcgttccctttgcgttctcatacagctcgcggaactcgttgcacacattctctacataatccagaaattccggaaaatccagggtcagcttcagatatccaccatagccgatccggtcaataggttttctcagaatggcacgtcttgcggtaatccagttctcctttgcctccttcaccgggtctccgccgtcacaaaaagtatcggggaaaaagtacggtaaaaatcttccctccgtgtattttacaccttcaatatcggagatgagacgaagggtactaccgtttcctacactgcctaccaccgcatcaagtccaatggtggcaaattcctccataaacggctcggttccaatccagtgatccccaagaaacatcattgcctctttgccgtactcatgggtaatgtctaccatctctttggcaattttggcaacctccctgcgctggaatgcctggaaatctttgaactccctgctaggcacacggtactggttgttgtaataaccctggtcaatgatgtactcaggccggaacctgtaaccggcctccttttcaaactgctctaagatataagggctgacagaggcagaatagccataccagtccacatatttttctctctttaactcatcaaacatcaaggtaaactgatggaaaaaggttgtgtagcgaatcacattcacgtagggatgatccgcgcagtatttgcgaagacgctccagggaatatttgtgggtcttaggctgtctcacatcaaatgtaatctgatgttcaaagtttttccagtcgttggtaaccgcattgtacatatgtactggatcccagataatgtaagccagaaagctgaccgtgtattcatggaaaggaatggcatcatgaatgaccacgcagcccttttcctcctcatattcccaatgatctgcggacacaacattaccggtagaacggtcgacaacctcccaccaccgttctttgtcgtctctggtattgaccatcatcagttcctgggatatacctttcataaggggaatctccaagtcagtatccacagcagtgtaaaaggatgtcatcacatagcactgctgtacttcatccgggtttgcctttgcccactcgttgtccttccgggtagtataataggtggcataaatttttgccccggttctgaccagttcctctgggaactctgtaccgtcgcagtcacgaatggcatcagcaccccagcgtttcatcaattctatggtttccggcaccacatccaggttggtaggaatggttacacgtccctcttttaaagtcattggtctcttttcctcctgcaaaagttaagtcgttgtaacagcggtttacaacggaataatcgtattatcctcctcggtataagttccaccgcccatcttgttacggacaaaaggcacaccctccctcacataaaaagtgttatgggcgagcaaagcatccgggttctccgacgggcttaccgtgccccccagatcgtcatagctcacattatggcaaaaactgttgtgaattgcttctgactggcagaacataatgcatccgccctcgttttgtctgctgtaattgtattcgtaaatggttccatcaccagaatccgcatcgtaagccatcccgtcctgatttaatcttgtatctgccacttcattgcagcggaacagggcatccttgcacttccatggccagatgcctgctgccacttttccggcacggttctccggccggcagtaaatcctgtcattgatttcgcatgcaacggaatctgctgtattgtgttctactaatgggcgcaaagcatacatcgcagtgatgccatcgcccccagcggcttttacataattgtcccggatgaccatattttcatgtccgtatttcaaaaaggtatcctcgggcagttccgccccctggaatttgtcatgtgcataggtgtatccaacagcgattccccaacggcttgtcttgtatacaaagcagccttccacagtgatatctttaaagcgcgccacaccggtagctttttcatcggcaggctttaaagctgtcatataaatgccgccgttgttcatatgtttgtcatagacattgccattcacatcatggatagaaaggttgcgcagggtaatgccgctgcgcactcccttatcctttgccaccacagccacgccagtgcggttcattttatgaggagcactgtaatcttcccccaggatttccactgcctgattgctaatctcaatatcatggatgaccacatgctctacatcatataaaagtacggcagaggatacataaccttgataaacatgcgcaggtgaatccaatgttgtaccgtaatcctgataccagatgccctgtcccccggctgcaatcaggggcttttttccctcctcctcttcttccggtgaataagagccaatttcaatgggatgctccctggttccactgtcttttatctgcagaaactgatctgtaaaaacggaatcccgggccagcagcaccttatcgccagggtacagtctcaatctgtttacctgaaaaaggctggcaaacggggaatccatggtcagtccgtcgttactatcacgcccggttttctgattgacataatatgtcctgtatgagcctgtcataggcatcctccctcagtcttttttcgataatctgccggacatcctcatagtcaaacaaatctccatggtaacgcccgaacaaatcctggttattttcataaaatgcccgcttttcttcctccgtaaaaccgggacagacacccagcttttttatctgctccgagggctgaacgaaatccagcttaaatcgtgtgagttcgtactgaagatacatggctggagaataaaaacggacaccataaagagaattttccttatttttctttgcccgccttttttccaaagcctcgataccggcatcttcaatgagcccgaactgttttgcaagaagaagggctgcctgcgcctcctcccattcttttttatccagacaatatttccgattcattatttcactgctcctgcaattccattggcaaaactcttttgtaagcacagaaagataattgcggtaggaagggtacaaatcaatacccccagcattaacataccatagtctacgctgtaaccactttttaagtttgcaaccaacatgggcatggtaatctggttgctgtcctgtaaaataatcgttggccagagatagttattccaggcattcatgaaagttactgtcatggctgcgccgtaggtagacttcataattggcaggaacatggtaaaaaaaatcctgatctcactaagtccttccagacgggctgcctggataatatcatgagggaaagaacgggctgcctgccggaacatcataatgagaaatggtgtagaaagagaaggcagtgccagtgcaatccaggtattaaccagcttccatgaagaaaacattttaaacaaaggaatcataatagcaacaaagggaagcatcatggcaagaagcagaatgttcatcagaaggtctttgcccttgtcatgataaatctcaaagccatagcctgcgatggagcagattaacagtgcaatcacagtaatcacaattgcattgcggaaagagttaaacatggctcgtcccagattctggtttgcaatgagactctggtaattttccatcagataaacacctgggaacagttttccacggacaatatcaatgctggagttggttgctccacaaatcatatagtacaggggaaacgctgacaggaaactggcaatgattaaaataatataagcgatagttgtctttactttagtcacgtttgtcacctactttcatctggattgcagaaagaactgccacactcacaaggataaatacggaaattgctgccgcatagttaaatttgggtgtttccacaaaggagatattataaacataatgcgccagtgtcatggtggacttaccaggacctccggaagtcaggttaacagactcatcaaacaactgtagcgtacctgaagttgacataatagccgtcaacaggatggtaggcctcaataagggaatggtaatcttcataaactgctgaaaaggggtcgctccatcaatataacttgcttcgtatacggaatcatcaatattctgtaagcccgcaagatagaaaaccatattgtatccggtccatctccagatcagtgcaatgatgatgacaaaacgggctgcccatgcattctggaaccagtccactctgtcaaagccaagggtcgtaataatattatttaccagaccgtcctgggcaaataaggatttgaaaatcatggaataggataccagtgatgtcgcacatggaagaaagataagagtacggaaaatactctttcctttaatcttcggactgttcaaaagctgtgccagccccagtgccagaagtaacatgacaggcacctggattataaagtaaaatacagtgttaaacagacactgctggaacgtcttatcctttaatattctctggtaatttgccagccctgcaaatcctgatccttttttggtaaaggacaggataattgcctgtatcataggataaaagcaaaagataaagataagaagtgcagccggaattaaaaatgcccatccggtcaggttatgttttttttccaaactcatttttgctttcttctgtttcatataaattctcctgattaaaaagaatatcgtttcgcgatattctgcgccgcttttacgccgctttgggcgacatatatttctgtaaaaacctgtgcatcctcgcctgtgaaaaaataccgggaacgcaatacgctgatcccggtactggctcatttttcacttacttattcactaatgttaaattcaacagcatcctgtgcattctgaatttcttcatcaatatcagcaccattctgtactacgttagtgattgcatcggtcagtgcacttctaatatcattataatatgcaccatagttaattgcgggaactttgcctgcaaactcaacaatgtctttgtataccgcctgtccaccatagaaatcagaagtctgattgtaaacatccgactgtgctgcaggcagatagctggaaattgcgccggcgttagggagtaaatcatcgtataattcaacgctgccaccaaaggttgtctttaggaaatcaaatgccagttcagtgttcttgcaattagaagatactgcccagcttgcaccaccacagtttgcgtaattggtggcaccatcaatgccgtctaaagcaggcatgtttacaatagcccacttaccagactggtcttctgccgactgaatggatgacataatccagcagccctggataacaccagcagcctcacccttgttcatggatgcaatgtactgatcccagtcggtgtagtcaaccataatcccctcatcgattaactgcttgtaaacctcgattgcttttttcaaagctgcgttgtccgccagatgaacttcaccattaacgataggagatgcgcctgcagactgcagcatctcgataacaatttcagaaccgccggaacttgtcagcatgggaacaccgtttgcatcgacaacttttttcgccagctccatgaactcagaccaggttgtgtccttgaaatcttcaacggtaagaccggcagcctctaccatatcggaacggattgccataatagatgctccattatcaaaaggaataccgtagtgttttccttctgcggtagaatctcctaatttaccaccggagaaatcgtcaaaattaataccggaatctgataattctgtgaaaacctcgggataatttgcaatatttttctggaaagaattatcctgcatcaggaaaatgtccggcagtgtgtcataattatcggcctcagcagcggtaatgatgttctgctcaatatcggtgtaaaccttctcctgaatgtccagtttaaaattgggatgatctttctggtaaattgcctcagcctgtttcattgcatatacattgaaggttggatcccagcaccatacagtaagaacttcttcgccatctgctgcatctgtgccttcagcttctgttgcagactctgccgggctggtttcagctgcaccgccggatgcagaagtgcctgctgtgctgttactgcttccgcagcctgcaagtgtggaagcggtcatcgctgctataagcagtgtgcctactaatttctttctcatattaaatcctcctttgaaacaatacatcatttgttgatggtttcattatagctttccatatcctactattcaatttctatgttgtcctattctatcaatatcttgctgtttttactaaaaatatgagtattttgacaaccttttcattttcagcattattattttccgtcattttaacgtagtattttttattacaccgattttaatatgcaaaatgacgattcactacttttatgttatattatattgttcagcaagatattgatattcagcaacaatttaacacaatacaccgctgtcttttcgtgatataatgaatcctgacggattcatatttagaagttcctacgtaacttcagatgcgcagaaggcagcgcagaaacaacgcaaaaatgatattcatgaaaataagtttttggggaggtttttatgggaaatgaacgtttcgacatctccattccaaaagaatatttaacaagagataaagcaagacttttatatgtttcctctgcaacctacggtggtgactggatcagtacgccccacacccattactgttctgagcttttctatgtaattgacggtgtgggacaattccaggtagaagacaatatcttcccggtttctgccaatgatctggtggtcatcaatcccaatgtgtcccacacggaacttggtttcaatgccaatccattaaaatatatcgttttgggcattgaaggactggaactttccgttgaaaataacaacgccaacttctgcattgtaaatttcagggaaatcaaagataccgttaacttctatttaaaagtaatgctccgtgaaatcgaaacccgctctgccggctatgaaacagtctgtcaggatttgatggaaatccttatcgttcttttcggacgccagaccaatttttctacgattctcagtcccgcaaacaaaagagcgtcccacctctgcgattccgttcggcgctatattgatcagaactgcggggatgaactctccttggagcatctggcaaaattttcccatgtaaacaaatattatctggtacatgcctttactgatgagtatgggatttctcccatcaactatctcatgcatgcccgcgtaaaaaaagctgaaaagctgctggcaaccacagattactctctttctgtcatcagccatacctgtggtttttcctcctccagctatttttcccagacctttaaaaaagtagcaggagtttctcccagcagctaccgcaagacggtcaaatctgaccatggagaaatggaagacctttcccgctaacatacaggcaggaggtcctttatttatactcaaaattcgggatctgtccccagcgctccttaaaatagtgtgccgccatcttcggccgccggtctctggtaaagagaccctttttatttccgtcggcgcgcatgcatccctggattgtggcgaaatccgcaaaattccagacctgctcgccgatgaagaagctgcgcttgtcaaattccacattctgtctgcggtaatattccatctggaactcctcggagaacatttccggcacgctctcgtgaatccccgcaaccgcatccgcgccgtattctgtaatcatcaccggtttgttctgtttttcccagaaatccagttccatatttaatgcgtagcatgccgcgtcaagatcgccagacagattgtaccagccatagtaacggttcacgcacaccacgtccatcgtcctcgtcacgagatctctctcgtagttgttctggcagcacacgaaggttaccggacgatctgccggatcaaggctgtgcgtcagctcatagagcgagtgccagtaatcgtacgccgactccggaaaatgctcggtgtccggttcatttcccatcgaccacatgactacgcacggatgattcttgtcccttgcaatcatctcgcgcagcacctgctcgtggtgctctctgatgtggaaagtcttgtacgggtcgatcttatctcccgcgccgattccaaccgcaggcgtctcatcgatcacaacgataccttccctgtcgcacagctgatacatctcctccgcatacggatagtggctggtgcggaaagaattggcattcagccagtggatcagattgatatccttgacatccaggcacacatcgagtcctcttccgcggaaagccgcgtcttcgtgttttccaaaacccttaaaatagaacggttttccattgatcaaaaactgcgttccctctaccgccaccgtgcggatgccgaatgtctcctcgtagagatcctccccgtaagtgacactcgccgtatagaggtacggctcccccggccacggccaccacagtctggcatccgggattctgactgttccgcccgctccatccgccgctgccacctcattgccgtccgcgtccagaatacggatgcgcacctcatcctcacatacgctgcccgccgtcttaatctcataatttaccactccggtatcgccgtcaatatccggcaccagcgtaatgtcctcaatataagccgccggcgtcgtatagatgcggaccggacggttgattcccgcataattaaagaaatcaaaattcggcagattctgcggttttctccataccttcgccgcttcaacactcggcacgcccggattgtccgatccgaaaaatgccgtgctgccctcatttccgaccggaagcgtgctgtgatttacccggttgtccgccgcaacgacgagctccgccgtctctcccggcacaagctgatctgtcacatccacctcaaacggaagaaagccgcctttatgcgcagtcagaaatctgccatttaagtacacctttgcagcatgtgtaaccgcgtcaaagcggagcacgagacgctgtcccttcagataggacggaaccgtgatcttgcgctcgtaatacgcccagccgtaatggttccggtatttcgggtcgtccttctgatcgttgtacgatgccggcaccgccatcagctctgtgtcctcccccatcactaaggaatctcccggctccttctcatctcccagtttaaaattccatactccgccgagatctatcaccccgcgtactctgttctctcttggatacaacatcttttcttcctccattctttctactgatttcttcccgatagcttttgtctgggatttcttttattttacatttcttttgactgctctatgccgtctatcgcagcatggatttccccatcctgtttcgtgacagtatacatttttccacgcacccgcacggacgcatggaagtaatccacttcctttggaatatgcggtgcaaaatcgcagccgccttccggcgacagatggattccggcgatctcctctaagatcacaggcacgggcgcactcgcccacggatgacacaggctcgtgttccacttctgatctttcccccacgcctcaaagcaggtcgtcgctccctcccgcagcatgttacaccacccgtgatcgctgtcgtttagcagcagcctgtacacactttcataccgcccccgccgtgccagtgcaagcagcaggtaataacttaacatcacgccgcaggaaaatccccgtttttccagaaactcaatgacaggtgcttcctctgcctcctccagaagcccgaaatacagggcatacacgttggagtgaagcgatgtgtggctgcttgtttcactgtctgcaagaagccccgtctccttccggtaaaacgccctgcgatacgcgaaaaccggcttctccagctcatacggctcctctctgcccagcacacgggcgagcccgttgagcgtttttttcgcaccgagatacagggcattgatgacattatggcaccccgcccccacaacgggtcttgtcagcgcaaaatcatactcatcccgcagattttcgggccagtcgaccagattccacttgtctgccacctgcacaagcagcccgtccgcgcgctcgtactgcgcaaaatgccggatcatgccaagcgccgtcttatagtatggaagcagcgcagccgcgttgccggtgtaacggtagtatagtgccagcagctgcggatacatcagggaataatcggcgatctcctgcatcagtcctcccggtgcaaccgccagaagccccgggcagactgcccttgtctgcgcaaactgatcaatgcatttcaaaagcatctgcgtctccccggtcagcagtacctgcgcatgcgccgtcacaacggcatccccgagatattgtcctttttctctggtcgggcaatccacatagccctcctgcgttccgtattttaccgcgttcttacagatggaaaaaatctgctccagccgcttttcggaggacgtcacctctgcgccctcctccatcggatagtggcgtgtctgcacaaaaatcccacaaatgttcacgcccttccccggaagcagctttgcgtagcggaatcccttgtaatcatacggttccagactgcagcagccgtctgagagcgtccagatctcgtggtaggagcagttgcagcgcatctcgtagcggacgctgccgctctcatccagttcctctccgcagaagatttccacggtatcccccgcgcttccctccgccgtcaggcacaggcttccggcgacttcctctcccacatcgatccggatgctgccatcctcatagatctcgactttttccggcttgatgcgctccccgcaaagcatccgcgtcggctgtaaatacaaccggtaatccgcccactctgccgcagccggcgtcttccatccggcatcatcaaattccgcactgctccatccttccgggaattttctgctgtcaaagttttccagaaactgcgtatcatatccgattgttccgccgctgtacgcatccgtcctctcatagcaaaaacgaagcggtatccgacagtcctgcgcatccatcaactctgtggcaaacgcaaagcgcaggtcgccgctgttgtatacacggttgattaacccctgataatataaatgcagtccgaagcagtgctctccggcctccatcttccccagtggaatctcgttgtaatagtagtgatccggataaccgggcgcaggtccctccgccacaaatccggactccacgtacagcttgtagtgatcgtccgccgtcagtcttaacgtcaggttctcctgcgccgtctcaagcgtaaaacgcgcacgcaccagaacatgcagattccgccggaattccgctgtcagctgttgctctgcctccggttgtttttccccttcctcctgctccttgtgaaacagattaaccggtgtgatatgtgaaaattcgcggatcgtaagccactgtggactccattctgctttttctctgctcatctcttccgtcatcccgccatcctttccgggcgtttgctcttctgtctgcaattttcctgcttccttcttccgggcagtcgtactgcacagattcccttacagacagcttcctgattttttattatggtataaaaaaatagtgcatttttccatagactttcttatgaaaaaatacactatttctatgtcatttttatgctgcctgaaattacttactgcggctgttttccgatgtaagcaaggataccgccgtccacatacagtacgtggccgttgacaaaatcagatgcgtccgaagctaagaatactgccggtccctgtaaatcctcggcgcttccccatcttgctgccggggtctttgcgatgatgaactggtcaaacggatgtctgcttccgtccggctggatctcgcggagcggtgcggtctgcggagttgcaatataacccggtccgatgccgttgcactggatattgtactcgccatactccgatgcaatgtttctggtcagcatctttaagccgccctttgccgctgcataagcggatacagtctcacggccaagctcggacatcatggagcagatgttgatgatcttgccgtgtccttttttgatcatagacggaatcaccgccttggaaacgataaacggtgcgttcagatccacatcgatgacctgtctgaactctgctgcggacatctcgcacatcggaatacgcttgatgatgccagcattgtttaccagaatgtcgatcacgccgacctctttttcgatctttgcaaccagtgcgtttacctgctcctcatctgtgacatcgcagacatatccgtgcgctttgatgcccagctcctcataagcggcaagtcccttgtcgacaagctcctgcttgatgtcgttgaatacgatcgttgcgcccgcctgtgcatatgcagatgcgattgcgaatccgatgccgtaggatgcgcctgttaccagcgctacttttccctctaatgaaaaattaaccatagttttccgtcctttctttttccctcttattgatctggtactgctcattgcttacacctagtatatcatgtgcaaaaccagcacatgatcaacattcgccgttcgtcaatcatgcaagcatgttgactcacttgcgctcattatatcatgtatgttattccatttcctgcaatattgtattataaatcttgcaaatattgaacttttgtcctatgctgtgtaaagagacatgcgctacagaacacataacaccacaaggcacatagcgccactggcgcattaaaaaacggcggcactaccgcctggaatcgtaagaacggagaacctatgaatagctgtataacctgcaaagaagccatcgaacactgcatgagcacccacacattcgcgttcgcccatctctacggcgatgagaaaatcatggacatgcacattcacaactgctgcgaagtctattactcgatttccggcggaaaacagtttctgatcgaccactgcctgtacgacatccgccccggcgatcttttcttaatcaaccaatttgaaagccaccacctgacacagatcgatcagcagacacacgagcggatcatcctctccatcgacccggaatacttatcgaagctctccaccggcgtgacgaatcttggccattgtttttctttccgtgacaccagaatgccgcaccagatccacctctcccccaaggagcagaaccgctttatgtactttattcacgagctgcatgacgatggcggcatgggggaagacctcttggatcaggcaatctttctggaattgatggtctttttaaacagagccttcgccgcccgctgcacagacgccgcagcccccgccccggctccatcttccaattaccacgcccaggtggacgccattttatcctacatcaactcccatatcggcgagccgctgacgctcgccggtctgtccgcgcatttttttatgagcacgtcctatctgtgccgtattttcaaggaggccaccggcaccaccatcaacaaatacatcaccgcaaagcgcatcaccctgtccaaatcgctgctcgatcagggctactccgtctcggaagcctgcgaggtctgcggcttcaacgactacagcaattatctgcgtgccttcacaaaagcagtcggcatctctccgaaaaagtacgcgcagtttcactcctgaccggttatatctgttccttctgctctacctcgcttataaatttttctatcagcctgtttacttcatccggctggtccgtattggaattatgaccagcattctttatccatttaagcggcaacccttctctctgatgccatttcttattatagcttttggctgagcccgctttatccttttcgccacagataagtaatgccggacaactgatatgatatggcagatctgctttgatcgcctcagcaagcattctgtaaccaaaaccggcaagccttgcatattcttcagaatctggatcataggacatcatcatcttccgcataagattctgaccataatccgtctctgcacatcctcttgaaccagccctaagaagtgctttccatggatagatcttatataatggctctgctctttcaagaagccatatttccattgctgtcatataagacttttgaagcggtgcagaatcaatggagataaagccttttatcttatccggatataattccatatacatttgagccagatatcccccatagactgaccgataatgatgggattataaatttcttcttttgttaatatttcatcaagccattctgccatgtcagacagactgtaattattcataaatggtctggataatgcatgtgatggtgcatcccatacaaacacattctgtttcttctcaaaatattctgtctgcttttcaaaaagcctgtgatctgctgtaagtcccggcaaaaacactaacgtaattttctgcttgtctattatatttacaaaataatggatgcagccacagggtgtcttataactgttttcggtcattttccatcccttttccataaactatttcccaatgatttatcatttccagatattcctgctcaaaagctgttacatcataatttcctgttctgtaccaatatttaagcatcccatctgaagcatacagaatttctttatatatactggtaaactctatatccttacggatgaaatcaagattcaaaattgacagaagcatttccaatgtcttttttgcagcatcctgtacatccggttggatgatggattgaatatcgggctcggtttcaaaaaaaatcatctgtttcatataccttatattgacgcatgtacttttttgttaaatccgctgcatgcttccatagaaaaagatatagctcctgcttgttatgaaaataatgaaacaaaagtgacttggatattcctgcttctgccgcaatttctgaggttggtgcctttttatattgattcgttgcaaatactttatatgcagcatttaatatttgcgattgtttttcttccggcaatgcataaaatttttcattcataagctgcctccgttgaccaattcggttaatgcgagtatatacccgttgaccgattaacggaagaccccatttgatcatctatccctgcaacttttgattttgtatttccattcattgaaaaaaggcatcaaagccatctctgttaaagttacccttttttctgaaatacatatcaaaatcatttcaaaaattagcttgacatattaccagattgctttcctatctatctcgctgataaatttttctataagtctgtttacttcatccggctggtcagtattggaattatgaccagcattctgtacccaaaaccagcaagccgtgcatattctttatccagtgcaataatcctgggatggtctttattgtctgccttcttgtattgtgcatttaccgctccaaacagcggcacatccatggccattgctttttcgcctccgccgaaccgattaaacgcaacattggtcagtggcttctttgtctcttcctcaagtttggctttttctgtatgaatcttactccggaagtgccctgcaacccgttcaatatcttccaccgtaagcagttcccgatcacgaagaagaatctgctccagatccaccgtatccagttcccggtcattatccgctttacacggcttcccgtacttaattaactttttaaataaacgcaatcatatacagcggcaacgtaatgattccctcctcgctcacacctatattgccatccgcaaatttgtatccgtaagatatatctttgttattcttcataagccattttaatgaatttgcccgggtatttctgctcttgacttcgataggaaccacgctcccgtctttctggatgataacatcgatttctcttttcgttgtgtcatttttatagaagtatatctgatatcccttcttataaagagcatctgctattgcacattcatagataccgccttttgagtttccagctaatgtattttctacaatatgctgttttaaagaaaaatccttcatcgccatcagcagtgataaatcagttgtatatgcccggaaaaagtcgtctcttgcataatcatccaaatcaaatctgacatccgtcacccgtttgcataattgcaccatatctgctcgaagcagccattcaacacttgaataatacttttgtgcccttccgccatgctcaatttctttatactgaaatttatggttttccttatctaatagctgctttgcaagcgagagataacatttttctgcctttaccttttcttcagcagttgcataatgtgctatatcatactggtatccctgtaagagatttctttgaaccctgtcaacttctctgaaatcctttatatctatatatttctgtactacttccggcataccgcctgttgcaacatactgtctgtaataattcatcatctgcgaatgaatcgcctcaggtatcactgtctttgaatgtaaatatccacaaagattctctatcatatcttcggaaactcccattccccaaagaaattcttcaaaatccatgccatacattctcagataatcaacatagccgacaggataggaagacgcacgtttataatcaattcccagaagtgatcctgaggcaaccacatcatatctgttatctatcgcccagaacttgagcgatgtaattgcctcctggcattcctgaatttcatccagaaaaatcaaagtttttccgggaacaattttcctttccggaaagcgaaaacgcatagccataatcatattgtctactgtaagatctccggcaaaaatatccattgccgaaggcatctgcttaaaattaatttcaagcagttcctcaaagttttcctccgcaaatcgttcgatgatatatgttttccctgtttgtctggcaccctgaacaaccaagcactttttatcctttgtatccatccagtttttaatgtaagccgtcgcttttcttttcagcataaagcacctcaaatcaatgaatttcattcctgttattgtttttaatcaacattttagaatatcaaaatgtaatttctgtcaacatttcagaaaattatatcatttttttaatgttcaggcaagctgctaatgggcatatattattgacaaccgttacagaatcatgagaagcgttcccgccacaatcagtacaagaccaagcgccgcccttttcgtcagcttctcatgaaataccagataagaaaaagcgatggtgacaaggatactcaatttatcaattggcactaccacgctcgcaagtccgtcctgcagcgctttgtaatagcagagccaggaaccgccggttgcaagtcccgacagacagataaatccgagttccttcctgtcaatcctgccaatctccttctgcttgcccttcgcaaataccatgatccatgccatcaaaagtaccaccgccgtccgaattgctgttccgagattggaattgagtccctcgatgccgatcttgccgagaatcgaagtgagacttgcaaaaccggcggataggcaggcgtacaaaagccagctctttttctcctgccccacgctcttttccgtctccttcttctggatcataaggaaggtaccggcgccgattaagatgacacacacaatcttaagtgcgctgacttcctctcccaaaaaaagaaacgccagcacaatggtcagaattgtactggacttatcaatcggaaccaccttattcacgtcacctgcctgcaaggcatgaaagtagcacagccaggatgctcccgtcgcaacccctgagagaatcagaaacagccatgtcttgccggatacagccgcaatgccgtcctgtgcccccacgacgaacaccataatccatgaaaaaacaagaaccacgatcgtgcggatcgccgtcgccacatccgagtctgtatggcggataccgcattttgccagaatcgacgtaagtcccgcaaacagcgcagaaccaaacgcatagaaaatccacatacgaatgcctcctctacgatacaccttttctcccgcgtatcacaataatgtcatttaactttaagagtgtgtccttctgcggcaggatggataaatcgtcgcgcagaattaaaaacaccgtcagctgctgctcatcctgcacttctcccacggtctttcccgcatatcttctgtccacaaaaatctccgcaatctccttgatgtccgcatcctggatatttgagatgctgctctttctctgatactgctccacgaatccggcgctgatgataccggtcgggatcgctaccacgccgacgccgagatacgcaatacagatcgccatcagacgccccagcgtcgtgatcggataaatatcgccgtatccgaccgtaagaagcgttgacatgctccaccagacgccgctgaatgcattgcggaacacttccggctgcgcgtcatgctccacactgtacatgcacagactgctcgcaagcatcaggatcaccacgataaacaccgaggaaatgatctgattccgcttctcgtacagtaccgtcgtgatgacattaaatgaatcatatcttgcattcaagcggaagagatgaaagattcttgccacccggagcatccgaaagatcacaaatccggacaaaaagaacaccggaacaatggtcagaatgtccaccacgccgtcaaaagacaccataaagcgcagtctggcgcggcatttgcgcattcccggatataaaagatccgccgtccagatgcggagcacatactccacacaaaaaataaagagcgtgatgacctccaccacgaaaaagaaaccggacagaaagtccagttcctcaaacgtctgtaaaaatgtaaccagaatatttgagacaatcgtaattgtgataaaaatatcgaacgcacggctgatccggttactcttatctccaatctggataatgttaaatattttttctctcaccttatgaatccatctcccagcgtaactctgatattttcggtgtccgacggatcctaccggtcatggacggctccgatcagttcccggatatcctccacctgatagcgctccatgtaggcgcggattccgtcaacgatctcctccgtcgcatgcggatgatagaagttcgccgtaccgaccgagactgcggtcgcaccggcaagaatcatctcgatggcatcctccgccgtctggattccgcccattccgataatcggaatctttaccgcctgcgcactctggtagaccatgcgcaccgcgaccggatgcactgccggaccagacataccacccgtgcggtttgccagcgcaaagcatcttctgtgaatatcaatcttcattcctgtgatcgtattgatcatggagagtgcatccgcaccgcccgcttccgctgcacgcgccatctccgtgatgtcggtgacattcggggaaagcttcatgatgaccggctgctttgcatggcgtttcatctcttttgtgacttcttcgaccatcttcggattctgtccgaacgcaataccgccctcctttacattcgggcaggaaatattgatctcgagcagatctaccggctggtcggagaggcgttccaccacatcaatgtattcctccgtcgtatgtccgcagacattgacgatgatcttcgtgtcatattttttgaggaacggaatgtctctgtcaacgaacagatcaatgcccggattctgtaaaccgatcgcattgagcatgccgccgtagacctccgccacacgcggcgtcggatttccttcccacggcacattcgcaacgcccttggtcacaactgctcccagcttattcaaatcgacaaactccgaatactcctccccggaaccgaacgtgccggatgccgtcataaccggatttttcagtgcgacaccgcacagatcaatgccaagattcatcagaaatccacctcctctgcccgaaataccggtccttccttacagactctcttgttcttcacattggaatgcgcatccttctctgtggacttgcagacgcaggcaaggcaggcgccgatgccgcacgccatgcgctcctccatggagatccaacattcgatgccttcctttgcggcatactcctttaaggcgcggagcatcggaagcggtccgcaggcgtagatcacatccgcggtcagcccgttctcgcggatggcgtcgagcacattgccctccgttcccacactgccgtcctccgttgcgatatagacctctccctgtttgcggaactcatccagcagaaacagctcatcccggtatccaagcacaatctgtttctcgcagtttaactcttttgcgagctctaacatcggcggaatcccaatgccgccgccgattaaaaacgcctttttctcctgcttcgggaagccgttgccgagtggtcctatcaccttaagctgcataccggtgtgcatggaagaaaactcttcggttccctttcccgccacgcggtataccagacggagcgcgccgtcctttctgtcgatctcacagatactgatcggtctcgggagcagcctgctgccttccttacagtagaccgatacaaactgccctgcctttgcatgcgccgcgatctgctcggtgtgcagccacatgctgtaaatatcgtccgcaatctcttcctgtttgattatgattgccgtctcttcaaatttctgttgtgttgtatgcatgatcttttatttttccttatcttcatataccacttgtccgttcacaagtgtcattcgcactttaccggtgacttttctgccgtcaaacggggtattcctgcccttgctgaaaaacgtgttcttgtcaatcacgtacgtctcgtccgggtcaaaaataacgatgtctgcgacctttccaggctcaatatctcccttgtcgattccgataatcttcgccggattgtaactcatcttctccgccatctgcatcggcgtcagatacccgccgagtacaagctccgtgtacgttaagcatgcggcggtctcaagacccacaataccgaacggtgcggatttcatggaggtattcttgtcctcaaacgtgtgcggcgcatggtcggttgcgatcacatccatcacgtcatcccgcagtccctcttttaacgcctgtacatcctccttcgtgcgcagcggcggattcatcttgtaattcgtgtccgcatccgcctcgatcgccacttttttctccgtatccacggtcggctcgatcttcctgatgtcatcggaagtcagtgtaaaatgatgcgggcacacctctgccgtcacatggattccctccatcttagcatgcttgaccatgctgacagaatccttcgtggagcagtggcacaagtgcagtctcgccccggtatcccggcttaacatgatgtccctggcaatgatgatgtcctccacggaattcgtgatgccgccaagtccaagttctctggcattgacatccgcattcatgacaccgccgttgacaagattgatgtcctcgcagtgagcgagcaccgcaatgttgtacttcgcagcaagttccatcgcctctctgtaaagctgtgcattcatgacggatttgccgtcctcactgatggcaggaattccggctttcaccatgccctcgatgtcggaaagctcctttccctgctgtcccttcgtcaccgcaccgacctgcagcacgttggcagcgccgacggtctttgctttgttgtgcacatagttcacaacatccggattatccacgaccggcttggtgttcggcatggcaagaatcgtcgtaaatccgccgtgcactgctgcccttgcgcctgtctcgatcgtctccttctgttcaaatcccggatctcttaaatgcacatgcatgtcgataaaccccggcatgacaaagcagcccttcgcatcgatcacgcggtcgcatttttccttgatactcttctcggttctggccacaaccccgttctccaccagcacatccagtgtctcatccgttccggtggcaggattgattacgcgtccatttttgatcaatatggtcatctttttttcctccattgtatgagttcatcttatcatatccgcctacagttttccatacaattccagcggcacatacgccttcacatagatcccctccgggcggtaatcctcctctaaaagctctccctgctttctgatctgctgcaggattccggcatccgcataggcgatggttcgctcaatcagaactttgttctcgcgcagaagttccgcaagcagttcttttaactcgtcgagccccgttccctctcttgccgagactgccagggtatgatctgccctcagatcatgcagcggctcccgctccgtcaccgcgtcctgcttgttaaaaagcgtgatgaccatcttttcccggatatccagctgatagagcgtgtcatagacaatgtgcatctgcttctcgtgctgcgggttggaagcatccaccacatgcagaatgtagtccgcatattttgcctcctcgagcgtactcttaaacgcctcgatcagatggtgcggcagcttccttataaaaccgaccgtatcggtcagaagaatctcctgtctgcccggaagttctaagacgcgcgttgtcgggtcaagtgtggcaaacagcttgtcctcctctaacaccccggcgtcggtaagccggttcaacagtgtggactttccggcattcgtgtagccgacgatcgccgccacaggcatcccgtttctcgtgcgcttcgcgcgtgtgatctcgcggtgctggcgcacctcctttaattcccggttcagctgtgcgatgcggtctttgatgagacgtctgtccatctccagctttttctcacccggccctctcgttccgattccgccgccgagtctggacatggaacgcccgaggccggtcagacggctgaggcggtattttaactgcgccagttccacctgtatttttccctcgctcgtcgtggcgcgtgccgcaaagatatccaggataatcagcgtgcggtccatcaccttggtgtctaacatctgctctaagttcttaagctgtgccggtgaaagttcatcgtcacagacgatgccggtcgcgccccgctctgcgatcatcgccgcgatctccgccacttttccggtgcccacataggtgcccgggtgcatcagttccctcttctggatcagtgtgccgaccacgacagctcccgctgtcctgacaagctccgccagctctgccacagagtcctcggcatcatccccatcctgctcgctcacgccgaccagaatcaccttttcgatctgatcttccaattcaataatttctgccatgctgctccttttctactgtccgctgtctccgcttccgtctgttccggcatcggctccgctgtcggttccatctgcaccgtctgttccgtccgttccgctgtctgcttctgctgttccgatatcctccgtcacgactacctcgccctgcacttctgtgcccgccggcgtatccacccggctttttaagaatgtgtattcgcgcagtgcctccgcatcatcagggtacgcggctgtataagcggtcatcacctcataagctcccgcaaaatctccggtatactccatgcagataatctgattctgcagcagcgcgcgcctgttcggaacactctccatcgaaagcccctgctcgatgtaggaaagcgcaccgctataattcagcttgcccatctcaatctgtgccaatgcattcatcgcttccgaatccgcgacacccgcatccacataagcctgataatacgtctgcgcgttcgccgtgtcctgctgtgcctcatatacctgcgcaagcgtcaggttcgccgctgcactgcctgcatcgatcgcggacgtcaattctttgattgcgttgtcatactgccccagcaggtagtaaatctcccctctgtatgcaagactttccgcatcatttcccttgatggaaaacgcgtcgtttaagtacgccgtgccgtcctccgccagatcataggcggcaagattcttgtaaatattgatataaagttcataatccgaatggttatacttgaccgcgtccgcaaaatcctgcttcgccccgtccgtatccccggtgccaagctttaaacatccgcgcagatagtaagcattggcgttcttcccgtcataatcaatcatggcgttgtacgtctcaagtgctccctcagtgtcctgtgcggcatactgggctgccgccttgtaatagcagatgtcgatctccagatcggtaatttttccggtgcagcacgcaagcgctccgtcaaatgccgccagtgccccctcataatccccgctctgcatgctctctatgccaatcttgcggtaggaaagctcatcctccgtgcgctcattcgcacatccggcaagaagcgcggctgtcacaagcaaaaacaccgccgcttttcccctgtatgttctatggtgattgatttccattcgtcttctcatcttaattcctctttttactataatgaagccaccaaaaagtataaacgatattttccttccccgcaaggtgatttcccgctgcaacaggcgatatcttccatgtacatgacttttctatctcatgccgtcccgaatcacgcgcgccgtgttctgataggcaatctgctccacggcgtcttcggagagtcctctctttcgcagcgcatcgaaaagcagcggcagcttcgtgcagtcactgatctcaaattcgcctgagattccgtcaaagtccgtgccgagtcccacacattcgataccgcccctgtcaatcagatgcattgcgtggtcgcagatgcgctcgatacggctgaccttatccgtctcgtcctcattcagaaaggtcggttccagattcagtcccgccactccgccacactctgccagttcgcggatcattgcgtcagtaagattgcgcgttgccggcgccagtgcccggcagttggaatgtgatgccacgaatggcacgccgcttcgccgggacgcttctgcgacatcccggaaacctccgtcggataaatgggagacgtcgactaagattcccagttcctgcatatagcgcactgcctcttttccaaatccggtcagcccacggctcatctcctccggcttttgggaatggcagtgtcccagacagttgtcgtcattccaggtcagtgtcacaagtcttacgccgagatcgtaaatttcccggattttgtccattttcccatcaatcagagaaccgttctcaatcgtgagaaacgccgatattttcccttcattctgattctgctttaattcctctgcattgtgcgctgcagcaaagcggtcaccgtactgctccatggtatggcagaaaatgtcatacattttcctcatgagtacttccgccgacggcatctcttctaagccgaaccagtccggatcatttctctgcggcagaaacatcgcaaaaaactgcgctcctgcctctgcctgctgcaggcgcagtccatccaccatcgtgcggtcaagttccagaaacgtctctgttttctgcgctaacgcgcttcccaatgtatcacaatgcatgtcaatataacgcatcattttctccatttccgggcagagttccttcttattttccggactgctgccctgtctttttcttattataaagaacccgcggactttatacaatatgccggccgccggattttgtacagcattttctctgtttccactgttttcatacaaaaaggagcgccttgcggcactcctctctgtgaaagaaatatataaattttgaagcaagctttttcttccgggcggttttccccggttttacagatgccagatgtcctcattgtactgtgcgatcgtacggtcagaggagaagaagccggctttgctgatgttgatgagcattttcttcgcccatgccatgcggtcttcataatccgcatagatgcgctcctttgttgccacataatcctcgaaatccggaagcgtcatgaaccagtctttgttcagaagttcgttgtaaagacgctctaaattctctctgcatccgactgccatcatctcgtcgctcacgataaagtctaccgcgcgcttgatgttcgcatcattctcatagtagcttctggacacataatctgccttctcgtagtgcttgatgacttcctcggaggactcaccgaagatgtaaatgttgtcgtcgccgacaaactgatgcatctccacgtttgcaccgtccatggttccgattgccactgcaccgtttaacatgaacttcatgttggatgttccggacgcctccttggaagcaagggaaatctgctcgtggatatctgccgccgggatcagcttttcagccagcgtgacattgtagttttccaccatcacaacctttaagtacggagatacctccggatcatttgcaatcaactcggacaggcagaggatcaggtgaatgatatcttttgcaatcacgtaagccggggctgccttggcaccgaaaatcacggtgatcggacgggtcggcttcttgcctgccttgatctcgaaatatttgtggatgacgtacagcgcattcatctgctgtctcttgtactcgtgcagacgcttgatctggatatcgtaaatggaattgtcatccagcacgattccctgtgtttttgcaagataatctttcagctcggtctttctgctgttcttgacatcaagcaggcgctgcagaacggaagcgtcatcgacaagcgcgccgagcttctccagctccatcgcatccttcttaaagcccggtccgatcagggattcaatcagatctgccagctcgtggttgcagtgcagcagccagcggcggaaggtaatgccgtttgtcttattgttgaacttctccggatagatcttgtagaagttgttgagctccgtatttttcaaaatttccgtgtgcaggtaggcaacgccgttgacactgtagccataatgaatatccatatgtgccatatgcacgcgtttctcgtcatcaatgatcgcaaccgacttgtcatcgtatttgcgtaccacgcggctgttcagttcgtagataatcggaagaagctgcggaactgccttttctaaaaaatgaatcggccatttttccagtgcctccgcaagaatcgtgtggttggtgtatgcgcaggtcttcgatacgatctcaatcgcctcatccatcagaattccacgctgcatcagaagacggatcagctccggaatcaccatgctcgggtgtgtatcgttgatctggattgccgcgtactcattcaacttgtgcagatcaccgcctcttgccagcgtctcatcgatgatgagctgtgccgcattgctgaccataaaatactgctggtatacacgcaggatgcgtcccttgtcatccgaatcgtccgggtataagaacagcgtcaggttctttgcaatatcctctttgtcaaaattgatgccgtcccctacaaggctctcgtccacggtctccacatcaaacagatgaagctttgtggtgcggttctcgtaaccaatcacatcgatatcatacagtctggactgtaaggtaaaaccgccgaactgtaccgggtaggtcacgttcgtttttgtcagccagctctccttctcgatccacgggttcggctcctcgtgctgtaaattgtgctcaaatacctgtttgaacagaccgtagtgataattgagacccacgccgtcgccgtttaatccgagcgttgcaatggaatccaggaagcatgctgccagacgacccagaccgccgtttccgagagacggctccggctcaacctcctcgatctctgccaggttcttgccgttctccgccagaacctgctttacttcctcataaataccgaggttgatcaggttgttggataacagcttaccaatcaaaaactcggcggagatataataaagcttgcgctttccctcgttgctctccttttccttcgccatgctctttgtcatctcaagcagcgcgtaataaatctcttcgttggagcactgtgcaatgcccttaccgtatctgttgtttacgatttcctgtacgttcatgatatcctccttgttttgcgaagcaaaatgcgactgctcttgcaggagcagaggattttactccttgttttgcatccccaattactttttgtatttccctgctgtatgagaacattatatgcagaagtccactttttttcttgtcatattatccccaaaagtggtacaatcctatcatgaacattttagagtatgaaaactatcaggaaaaaattccacatggtaacccgctgtttccttatatcacctacccttgctcgattccgcttgacttttcacgcgtgcctctgcactggcacgatgagatggaaatcatctatatcaaaaaaggaaccggagcaatcacggtcgatttcaaatcctacgtggtaaccgggggaaccatcgcgctgattctgccgggcaggctacacagcattgaacagtacatgcaggaaagcatggaatacgaaaatatcattttccatccgggcatcctcatttccaaaaaaacggacaccagcaataccgaatttcttgcgccgctgttgtcgggcgtcctgtccgttccgctcttatatcagccgggatctccctgctatgcggagattgccgcctgcattgacgccaacgatgaaatcagccggacgaacccgcccggctatcagttctttatcaagagtcagctctttatgcttttttacattttattcagcaaatgcctcttaaaagagccggcgaaacgcgatcacaagtcgctggagaagatgaagctgatcttaaagtatctggagaaccattatatggagcgcattacgattgcagatgtctcggcggaggtcgggctgagccagtcgcatttcatgaagtatttcaagaatacgatgggcacttccttcatcgaatatctcaatgaataccgcctgaccatggcttcccgcctgttgatctcctccgaatcctcgattcttgccatcgcagaggaagtcggctacgagaatctgtcgtactttaaccgcactttcaaaaaaagattcggcatgacgccccgggattaccgaaaacaatccacgaagcagttgtaaaacgggtcccacagaggattttccttgttttagacccgtttttcttcatttttccagtcaaaatggtgctttttctatgtaaaacgggtccagagcagattttttcctctgccagacccgttttttgcaaaaatccgggtcccacagtcatttttttctcctgtggacccggatacctctttttcacacgtctgaacataccatctggacagtttttctttttctcgtgctttctctttcttttttcttacgattctatatcaaagtcaatgcttcccataccgcagtccagatcaatcgttcccacagccccggcattcgtgactttgtagcttccgctgagatcggaatagctttctccgtttaccgtgagatcccccatgccgcaggacatcttataattatagtcctcttccctgccgcgcagggtgatgctgccatcccccatgccgcaatgcgctttcacattctctgccacaatgccgtccagcgcaaatgatcccataccgcaatccagcttaatatctttataggtgcctccttccagatcaatatcaccggctccaagcttgatgtccagggttcctgtcacagcaaaatctgctcccgtcagttcccctgctcccacattcagctccatcgttctgcagttcacactgcccgatgcaaaatctgcatctgccgccccgatgtcaaagtccatggtatcaaaggtcattttctccggaatctcaatcacaatctgcgcatcataattgtccggaaactgcttatgaatctcatactgaatctgaagcgtatctttattcatatcccctttataatatttttctttgcagccgtaggttctcaccacaaggtttttatcatccgtcccctgcttgacatagatttccgcagcatcaatatcaatatccagattttttatgccggctgcctcataggtataaacttttgcatcgtcgtctgctccccagtcatcctctgtgtcttcttcatccgaagaatagtaaagttcatatggccggatatgccagttgcccgcatccagttctcctctttccgccatgcgtctgattgccccaaagcctccgccaagcagagcggagatgccgccgagcaataatcccattcccccgagaactgccacaatgatcaggcagatttttgaaaattttttcatgctgccgcacgctcctttctcttattaaatggctttttgcaaagcttccagattcctttcaatgcccagggaagaaatcctccgaaaatccagaccacaagaaccaccgcaaggacaccgaacgcaaggacgatgagacctcctcccataagcccgattccgattgcaggatttcctgcaaatgcggttccgattcctgcaccaaagagcaccacaccgcagattaacagtgcgcccatgactgccacaaccgctattgcaattccaaacagcgccgccacaatgccgagcaatgctgacagtatgaccagaatcatcaccagccataccggcgaagtgatgaccagaagaacgatcgcccatcccggcattccatccttctcctgcgtagaatacgctgcattctgcgctgctccctgtggtactcccttcgatgcgttctgcgctgctccctgcactgccggattccactctgctcctgttgctgctccctccagtgcgctctgcactgccggattccactctgctcctgccgctgctccctgcgcgccggaagaacacgcttccccgggctgcacacccagatctttgataatgctgtccgccactttctgcggcgattccagttcttctaatatctttgcctcatttgcctctccggcgtcctcgaaataactgcggtaaaatgcaagtgcctccgttctttcctcctgtgaaatcccggacagcagcgcttccagctgccttaaaaattcatctttgttcatcttcaaactccctcctcggaaaataactctgatattttcgaagaatagtcatcccattctctgcgataatcgtccagcttctttcttccctcatccgtaatcctgtagtagcgcctgttgcggcctccacattctctgtcatacaccataaggcatccatctttctgaagtctacgcaataccggataaagtgtggattccgaaacctcaatcgccactctcacatcctgcgtgatcttatatccatatgtgccttcctcctccttggagacgaccgccagaacaatcgcatccagcagggctgcacctgtattgaacaccatattaccggctcctttcctgttctgtctgatattacttatatgtttataatattattttgttattaatactgtatatcatataatatagtattgtcaatattattattcaaaaaatgatacattcattttctaaaagagaaaaaaagaatcccgcaaacaggattctcctataaatcaaaaaatcgtacatgcatgtgtaacgcttacacaacatgtacgatttatattttccattcgctttatctttttctccggcttctgtccaccctacgcttcccagtccgcgcgtttgataatccccacgccgatcggatacggtccggtgtgaacgccaatcgttgcgccgatctggtaaatctcaatctcatcgatccccatgcgctccctcacgagatcttttaacatctcacgaaaatggcaggcctcctcataatcatagccataaccgatggcaaaactgtattcgcccggctttgcggcgcgttcgtccagataagctttgagcatctcgattactttctgcatggatttttcccggcttcgcgcaatgccggaggcaaaaatctcgccctccttcagagtaataagcggcttgatttttaatgcacttcccgcaatccccatcacttttccgattcttccgccatgctttaagtaatcaatgttgccgatcgtaaagaagattcttccgctctcccggatggtaagaagccgctccaccatgcggtcatactcccagccgaggtcacgcagccggcatgcctcaagcacatacaagccctgcagcaccgtgttgatctccgcgtcgatgactgtgatgcgcgccttgggatattcctctaaaatcatatctctggcggtcgtcgccgactgcatggagccgctgaacttcgtcgtgatacagatacagatcatcgggacatcctgctttgcaagcgggagaaacacctgataataatcatccaccgacggcatcgacgtcttcggaaatacatccgggtgatccaccattctctgatagaactcgcggatatccagttccaccccttctttcagataagtctctccatcaaaagatacatagaaaggcaccaccagaatatcgcgctcttttgtgagctctcttgaaaggtctaacgacccgtcgctgataatttgaatcttttcctgcataaatctccttcacatctgttctgtcagaataaataaacaccgcgctccgtgacacggatctccggaattaccgtaagcgccataaaagaaagggtaacaaacggatctacattctctgagataccaagttctctcgtctccttctgcatggcagagagcttttccgtgacttcctcataccgtctgtcgctcataagacccgcgatcggcagcggcagtacatcgattacctttccgccggacacgatcgcatagccgccctgctgctcctccacagtccggatggcaagcagaatgtcatcgtcattgtctcccgccacaatcatattgtgggaatcgtgcgcaacggacgtcgctacggcaccgccttttacgccaaagcccttgagcggtgccacaccgatctctccggtcttgccgtggcgttccaccacacagatcttattgtatacttcattcgggacaaaatatccgttttctgtcggcacttcttccaccagatgcgtcgtcacgatctgatgcgcattcatctgtatcacatcggtctttccgttgcatgcaagctgaatccgctctctggaaagctccccgacatgaaccgtgtgaagcagttcctccggcactggaacccaataatctttcttatagtcttcctctcccaggatcctgccgtccttcatcacatcggtcggacgcacctcctccagattatcgaggaacacaatgtcggcgtgatatccggctccgatggcaccgtatcccttaagcccgtaaaacattgccggctggtagcttcccatcttgtatgcctttgccaccggaaccccaagtgcaatcgccttgcggatacaggtgctgatatgcccttccttgcggatctcctcgatatgcttatcgtcggtgcagaatgcgcactggtcgagcgccacattggcgtctaaaagcgtgcggattaacgtgtcaagattcttagcgccgcttccctcacggatatagatgtgaaaaccggcgcgcagcttgtcgagcacttcctcagggctcgcacactcatgatcgttctccacgccggccagacggtacgcctgtaccgcctttcctgtaatgcccggcgcatgtccgtcgatgtgcttctttgcaaaaagttccagcttatccgacatccggcgctcgcccttgtagcactccacaaaacgcatggtctccccgagtcccagtactcttgcatcatccacatacttcatcatatcggacgccagaaactccccgcatccgtttgtctccacatcggttgccggaacagaggacggaatcatgaagaaaatatgtaccagcgccttgcccgcacatttcagaaaataatccattcccttcacgccgcacacattgacaatctcatgcggatccgcaacaatggtcgtcgttcccgcctgcaccagcaccttggacaattcgcccggggataccatactggattcgatatgcatatgggcatccaaaaatcccggcaccagatattttccggtacagtcgatctcctgctccccctcgtaggaaccgactcccacgatcgtgtcgccgcagattgcaacatccgcttccaggatctcctccgtgaatacgttcaacactttgccgtgctttaatacaatgtctgctttccggattccgttcgcgcaatccagccgtctctttctgtctaccatagattccttcctctcctccgtttacgaaaacaatcccttaaagaagtccgcgatcgagctgaatacatttgagaaaaatgtgcctacactcgagagcacgctgctgtctcctccgccgtccttaaaggaatggtacagtgactccgcataatccacaaggctgtcaagattgatccccagagatgtaatctttaagagcagatccacgatctgctggcgctcggaatctgacagtgtcacattatatttgctgcaggcatcatcaatcgcctggttgatgctcgcctcatctttcagatcattctgtgcaatgaccgacttgatgtaagcgataaactcttccacttcctcatcggaaagtccggcaatcgactgttctaactgcccggtaaccacgagctcatttaaggatgcgtcgatgatatccgcattgatcgtctcacctgtcatctcctggtatgccttgaatacgccgacaagcgccgccgtgccggagatctcctgcggtcctgcaacgatgatatccgcatcggtaatacccgccgttgtcaacgcatttttgtacatgccgactgtacagtaattgatattcctggttgaaatatttaatccgtttcccttatcgcgttttacgatcacaacggaagaccatgacttgcttccgatctgtgaggaactgatataggaatccagatactgatgctcctctgcattcgttgtatagaccacatcataattgccaaggttcgccggatcaatccccatcagggaaagcaccgtattcttctgggcatccgtcagatccgctcccagcgcaagatatggcttatcatccgcctggattgtcacgttatcactgtttgctcccgtggcagcgttctccgctgccgaagcctttgactgatcctgcgcctctgccgaagtctgatcctgccctgcctgattctgcgactctgctgaagtctgatcctgacttgtctggtctacgacaacctctccctctacattcgctgatgtatccgccgcggatgccgtcacaggcgccgatgcaagcatcaccgcagccagaaataaactggtaactctcattccattctttttcatgtgaaatcctccttccaaaacaagtctctattttactacgaactttccataaaaacaaccgacgttttccctccagccgatttatttatataaatttaagaaacctgtccggcaagattacagttccacatgcacgttcagccacgatacaatatccgccataacctgatcgcggtctgtctcgtttaaaatctcatgacggtcattctcgtacaggcggtaggtaatatccgaaagccccgcatctttgtacataccgtacaccttcttaacgccctcgcccagatctccgaccggatcgtccgcaccggatacaaaaaacagcggcagatttttcgggaccttttttatattctccatctgatcgtcaaacaataccgcctccatcagacccttgtaaccatttacggtaaacaggaatgtacagcgcggatcagcatagtatgccttgacattctccacgttcttggaaagccagctgttggcataatcctttccatataaatcgtagcgcttgtacggcttgctgtaggaaaggctctgcatcaggcggcttctgtaatgccatccacggaatagtgcgatcgtacggcataaaaacagtccaaacttcatcgtgctatccggcattgccccggttcccatgatgacggcgccagccactccctccgggtgaatacacaggtatttgcgcagcatgtaagatcccatgctgtgtcccatcataaaatacggcacgccggggttctctgtctggatcgtcgtgcgcagcgtgtgcatatcctcgacgagcgtgtcactcggatccggctctgcaaaatatcccaattcctcctcggatgcaaccgacgcaccatgtcccagatgatcatgtccgaccacaaggaccccctggtcatttaaaaattccgcgaacggcttatagcgttcaatatactccaccatgccgtgcgtgatctgcaagaccgcccggtactctccgctctccggcatccactttaccgcatgaatcttcgtctttccgtcctttgataaaaaactgaactgtttttcttttgtcatagcattgttccctcactttttattatttatactctctgattcctactctctgctctgtatcctttgcagcaaaaccggcatcatccggcttcccctgccgactgcaggatgctcttgcagacattctccagttcatccgcgctgctcttctgctctgccagttcctcctgcatgccggatacatatttcaggaatgcctccctggcgcgcacattttcgtccgccgactgctgcagcacatctgctctcgcgaccgccgtatcctggatcagccccctcagcccaatctgtccggtctcataagccgccatattctgcgcacagtcgcggtaaagctttcccatggaaatattattctccttgagcagctcgtttaagtggtgtacctgctcctccagagacgcgatccgttcttccgcctccccaagctggtcttttaacgccagcgcctcctgctcataatcgtccgcatatgcacgcacctgctctgccgccgtcacaaaccgggttccgctctcccccattcttcctgcttcgatcgcagaattgagcgccagcacccccatcgttttcgacagttcctccatgcgctctgccctctcaccaagtgcctggcgcatctcgcgaagcgcctgcggagcctccgagatatgcttcatcggcgtcgtaaagtgcttgttgttctccacgatctcgacgaccttttcattctgccccttcacctgctccataaaaacgctgtggttggcgtcgaacgtcgcgattccgttattcattgtgatcaacgtattgtgaagttctcccgccgcctgcgcgccgttctccgacaactccccgttctgctgcatctgctgttcgatctcttcgatctctttttccatctgtgcacgcgaggctgtcatgcgtgcaaactgttcctccgcggtatccttctgtcctgcgatcttatggagcagctccctctcgcgcttctccgtctcccttaatgccgcaagttcctcttctaataaagccttttctctctttccactaaacatagctactccttctgtccacccgccacgttctatttatagttgcgaatgatgagctggacactctccattccctgatatacattgatttccggatagtaaatcaccgacatccggatggcattcgccctgccgcgaagcgcagcgtccacctccgtctgcccgtatttttcgctgtaatactgcttccatgcctccacatccccaaaatagaccgcagagacatgttctcccgccgccgtcataagggacagcttcaacacattctggttcctgcccaccacagacgcccgcagaagcgcaagctccctgtccgcgaactgtggcttactgttgccatttccaaacggctctaagcgcgccagctcccggatcagcccgatcgtcggatacgcggcaggcattgccatatctatccttatcttaggtataaaatcttcttctgtcaattcacagcaggcatttattttgccgcggaataccgccacatcttcgcgcagcgacagccctgccgccatcggatgtccgccgaattttgaaaaacattcccggcacttgcacatctcgtcatacatcgagtacgcttccgtggatctgccggaccccttcaccccttcctcgccgtccgtcagaacaaataccggcttgtggtaggactcccggattctccccgcaatgatccccgccaggctttcatgcaccccaggcaaatagatcaccagcaccttctcgcccgctgttccctcgtcgacgatctgttttgccagttccacgccgtctgccgtcatgcttttgcgctgtgcgttcagttccacaagttcttttgcaattttccctgcattaatctcgtttttttgcaagaaaagattcagcgcaattttggctgtctccagccgaccgctggcgttgacgcagggaccaagcacaaatccgatatggtacgatgtgatctgctccggcgtcagctgattctgtaaaatcaaggcgcgcatgccaaggttcgctgtccggtgcagccgctttaatccctcccgcaccagaatccggttctcatccgtcagttccatgacatcgcccactgtcgcaaacgccacaaattccagaaacgcgaatgcctcctccgcgtcaatacaaaacttctcgtaaagcagctgtataatcttccacgccaccgtcgccccgcagagccctttgtacggataggaacactcctgctgcttcggattcacaatggcatccgccgcgctccgcagataccgccgcactccctgctcctccacatagggaatctcatggtgatccgtcaccagaaccgtcatccccagctctttcgcatgcgcaatctcattgatggctgcaatgccgttgtcgcaggtgatgatcgtgtccatcccctcctcatacgccgcatcgatcagatgctcgttgatgccgtagccgtcacgcatgcggtcgggaatcgcgcaggacacactgccgccgcatcgtgtgatcccctgatacagaatataggtagacatcacgccgtcgatgtcgtaatctccaatgatccggatcggtcttccctgccttatcttttctgacaggatacaaaccagcttctctgactcataaagcagatgcggatcatacagatccctgcatgtgccgttcagatatttatcaatcgccgcatcaccgatcaccccgcggttgcggatcagccgcgctgtcacgggactgatgccaaaccgttctgcaatcgcctgaaaatcggcgcctttttttatttcataccacttttccatcttcacttatgcctgttccatcgtattctgcccgtcgccttcgtattccacggagagaagcgccagccccagtgccggtgccgtgtagcccgccgcctgtctgtccctcctggcaagcacgtccgtcatactccccggctctcttctgccgtctcccacctcaatcagtgtccccgtcagaatccgcaccatattctgtaaaaaaccgttccccgtgaaaaaaagatctatctccgattcgtgttcctccacacgaatttcataaagcgtccgcactgtggactttttcattcttgtattgccgcagaacgacttaaaatcatgctcccccagaagaagtcccgccgcctcccgcatcctttccacatcaagcggaatcctgtaatcatacacatacctgcgcgcaaagacgtccggaacctctcccgtatgaatccggtagcggtaggttttgcacactgcctgatagcggctgtgaaaccgctcgtccacctctgtcaggctgcttacggcaatatcctccggaaggtaacggttcaatccatccagcagctcccccgtattgcgcggctgcttaagatgaaaattggcaacctgcccgatggcatgtactcccgcatcggttctcccggaacctatgacatccacctgctgtcccgtcatccgtgtcagaacagtctcaagcttgccctggatcgtcgcgtccgtcgcatgctggctctgccatccgctgtagcgcgtgccgtcatactgtattgtcatcctgtaattcgccataaaattctccaaaaaagtccccagtttgtaacttattctatcacaaaccggggaaaaaaccaacctctaaaccagctccgcaatgcgcgtaaccgcgacataaatctcggaaatacggtaccaggttcgaaagtcgatcactcccgtgaccggaagtccgaagatactctggaaacgctccaccgcctccctggttgccggcccgtagattccgtccggcgtaatcgtcggaatggccgggtaggaacgcgagatgcgcgccagctgttcctgaatctgccgaaccttttctcccgtcgatccgaccgacagatcgactctcggccaggacgccgggatgcccgagacctcctccgccgtgttgataaacatgttattgccgtaatagtagcgcagaatctcaatcgtctcataattctgatcgccgagatacttgcttccccactggctcagccagttgctgcaggtcacgcgctgcccgtcgcaatactgcgttaagatcggctgtctgacattcggtctggagagatagttctggaacatctcatccaccacatccgagatgctctggtaaatgttgcgcccgtacatgaatttctggtcatatgccgtggaggacgtgatcgtaaagctgtagcctttgttgcggtaccactccgtgtatacacgattgagcgtaaacgacatgatggcaagaacattcgcccggatcgtcgcgtccggccaggtcgaatagatctcgctggaggcaacgtttttgatgtaatcccgataacggacatagtagtctctggctgtcgggtcactcggagcgccgtcatgtacaatcacatattccgggatcaccacacggcttaaaacgatctctccggtttccgtgacgggtttgatctcggcttccgcgatcttgggcggatattccgcaaaaagggtatgtgccggaatgacgatgttatcggtcatgctttcggtggtttcctcggcgtccatccggatttcctgcagcgacagctgacccgaaaagacctcaatgccggagatattgatcggacgatatccttttgcagtgacctgaatggtatactccgcgtaaggctgcacctcgctcggctgcattgacagttcaagcggaggcgtatcaagcgtaagtgtttcggacattccggaagcatccgtgttcacctcctcgaccgtgctgtcgggatctccagaataggagatcgatatttttgcatcgtcgatcggcgtgctggttccccgctcgatgacctgcatcctgagatccccgcgatccacattctcgttctgtgcatatctgatatctggcataaaaacctcatcgattcttttcgtattatcatatgccggtgccagatgaaatgtgcgcatccgccctgccgaatcctgccgcaaaaaaacggattgtcactttgagcagccaaccccttttgcacgacgaggaatagaatgggaagatcatgcctatcgatttctgagggaatgcatctggaaattcggttcaaaaaatgtggcatttctaaccagccgaatgtttgcatcttcgatgatccgtgtttttccaagtttggagcactccgcgggtcatgtccgcatcccggaagacaatttgtaggacttttgtgtatgtcccttattggcacctctgaacaaaacataaccgcgcgaagccgctgtctgaggcggcatctgccctattttcaatagcagatgccagcgagttcggttcgcgcggttttatattgtctgtgaagaggtgccattagggacaccagaaagtccgcccattgtctccggtgtgtcggacatgccccgtcggattgtccaaacatggaagagacacggaattcgatgcaaacattcaaccggaagaaatgctcacatttttctccaacgaatattccatctgcatttccctcagaaatcggcaggatgtacttcttatcatattccttcgtacgccaaaaagggattgtctgctcaaagcggcaatcccttttccttccgttatatgctaagacacgcgcgtctcatccacaccttccacagatcttctgctttattctacggtaacaacctttgccagatttcttggcttatctacatcgaaccccttatcggaggacacatagtaagcgagaagctgcaatgccaccgatgccggcagcaccatgaactcatcctgcatatccggcagcgtgaaaatctcgtactccttcgctaaatctcccacaatgctttccttgataaaaacgacaacgtccgctcctctggactttacctccttaatgttggaaagttccttggacatcagtttttcctgcgtcaccgttgccaccaccggcgtatcctgcgtgatcagcgcgatcgggccgtgctttaattctccggatgcgtacgcctccgagtggatgtaggatacctcctttaacttcagcgatccctccagaagaatcgagtaatccagtcctcttccaatcatgaacaaatccttagcgccgagcacctttttggcaaccacatggatatccctgcggcgctccagcaccttcttcatgacctccggtgtccgctgcagctcccgcacaaagctctgggtctgcgcgtcgtcgaagacacctctgctatgcgccatacgcgccacgatcagataaaataccgcaagctgtgtcgtgtacgccttggtacttgccaccgcgatctccggtcccgcattggtgtagagcacatagtcgctctctcttgcaatggaggaacccttgacgttgatgatcgcaagacactttgccccgcggttcttcgcgtacttcaccgcctctaacgtatcgatcgtctcaccggactgcgacactgcaatcacaagcgtcttctcgtcgatgaccggatccgaatacatgaattcggaagccatctgcacctcaatgtgcatgtgaagaatggacttgacgagcgcctgtgccaccagtcccgcgtgcattgcggttccgcacgctacgatgcagatatgctcacactccgtaaaaagagtgtccggcacgccgtctgctgtaaaatccggcatacctccgacgatacggttcttgatggtattctcgatggcttccggctgctccataatctctttttccatatagaacggatagccgttcttcccggcgctgtttaattcccagtccacggtcagatacttcggcagcacctcattgccgtcaaaatccgtcagtgtcagtttgtccgcggagagctttaagatatgatactccggcacgacaaaataacggtttgtaaaacggcagagcgccgtcagatcactggcaagcatcgcgccttccttacagatcgtcgccacgatcgggctgacattgcgcgttgaatagatcacatccttctgatcttcaaataaaataacaagcgcaaatgttcctttcagcttggagacggtcttcttgatcgcttcccccggattcccttcgtagaaccggttcaaaagcgctgccaccacctcgctgtccgtctcggacttcagtgtatctgccagatcgtaatccgcaatcagttccctgtaattctcaatgatgccgttgtgtacgagtgtgacttttcccacttgatgcgggtgtgcattgcagtcgtttacaccgccatgcgtcgcccatctcgtatgaccgattccgcactgtgacactactttttccgacatacagatcgcccgcagatcactgactcttccggcacatttgcggacttctgtcttcccgctctcctcgtcgcgcagggcgatgccggcgctgtcgtaccctctgtactccaacagctccagcgcatccaaaaggacttctcttacgtcctcacttcctgtataacctataattccacacatatgatttccccatttctattacaatctgtatataacaatatttttattcaggtctcttctgtttctattccatcaaattctgttccatcaaacatcgtatttgttttgcagtcacccgcatatttgccgatgtgtctcgcactggaacggtgcggaaaggcatccgccgaattttcgatcacctttctcctcgttaacctgccagggcaggtgcatggcgcttagggaatctctgtggattacggtacagatcagattgcgtatctgaacatataacgttccccttatgcagttatcaaggttcaacgtgtttactatactatgatacgcgaaaaaagtccagaggggattctgttttgccgccgggtatgctatacttagctcatacaacagtgaaagaaggaacctcattcatgctcctgaaaaaccaaaaagaagacaccaccgactacaccaaagactggcccgcgcgctactacgacattcctaccggcgcactgcggcgcgaacaccttaagcgtgcaaaagcagaaggctttgccgttcctgcagattcctaccgggaaatgctctgcgagcggcgctttttttccgaaaaaaaagacggcactgtggatggttttttccgcgcctggaccatgatcaaggcttccgcagccgcaggcgtctcttttttccagaaaaagcgtcagaaaaaagaactgctcacttacatgaaggatctttgtctctccccggatgatctgcttcccgaatccgcggatgcggttctcatcgaagagtggcaggattttgcgcggggactcatctcctcctgcactgggagcaaagcctactgttcgacgctctttggttttgtgccgatcaaggatgccaaggtggcggaaaagctcgccgcagagattcttctggtaaccagggattacccggctctctttgatctggcggacgagtttgccccgttccgcaaagtcatgaccgatagcttctgccagatgattgagaacggcgagacctatctgcaagcataaaaaacagccgcacagaatgttttacacactctgtgcggctgttttctgcttatactttcctgtattttatttcatataattcttcacgtctctcgatcctaccttagaatacggaagtctgatgtattttccgttctccagattgaggtcgtctaacgtatcccccacggagagcgcgtaggcaagatcgagcattgcctgtgcctgcccttccttgtcgttgtagacggttcccaccatctcgccggatgccacggcggcaagtcccacatcagttccatcaattccgaccaccaccggccagtccgcccgcttcagatgcgaggttttcaacgcatcgatggctccgagcgccatatcatcattgttggcgattacaagctcgatctccccgtcatattccgcaagcatctgcgtcatcttggtctgcgcctgcgcccggttccagttcgcaatcccgtacgcgagcttttccacctccacgccgttgtctataatcgttgagaccgcatactcggtgcgcacgatcgcatcctgatgcccggcttctccctccagcaccacatactggaagacaccgtcaccgttcttatcagcatccggattctccttgaacgcatccgccgcaatctccccctgcatgattccggactcgaatgctttcgccccgacataatagaccctgtcccagcgctccagatcctcctccaccagttccctgttgaagaaaatgaccggcacattatttttttccgccatatcgatgatcgttgtcggctctgtccggtcgaccagattcacacagatcacattgcagccggcatctaacatttcctcgacctgactgttctgcgtcgactggcttccggccgcattgtagacttccacattgatggcaatgcccgtctgttcttcctgctctgccgcatattcgttgaaatccgtcatcatctgcgatacaaatgtgtcatactgatcatatacggtgacgccgatcttaatgcttgtcgctttctgtacctggccgtctgtcccgcagcccgccatgcttcccagtgacaccagcgcaccaagcccggccgccattcctcttagcatcctctgtgacataacacccttcctcacttctcctgtttctctctgctactgcacaatcgggaacagcactttctggatatccgcatcatacagatgttcccggtcgaccaccagataattgaccttgctgcttctcgtggtatccatgtgataaatcagctgctttgcgattgcctccatgctctgataccccatattgaattcattgggaaccacgagcgtctgtatccagcccttgtccagatagtatacatttttctcggaactgcccacgccgtacagcgagcaccggtcaagtctccagcccagctcatccccggcaaaaaaatccaccatcatctccgtctcgtcattgccgagtgcaatcagaatgtccaccggtttgtcctgctctaacgtatagaacgcgtccttgatgctctccgcctttccttccaggctccactcgacaactgcaccgctctcgcgcaatccctgcgatacccccgtataacgctgctgcatggagcgctggctctggctgcacgcaagaattcccacgcgcttgccggcaaggtcatccccgaaatcggactgcaccgcctgtgcgagcgctgctcccatctcctcattatccggcgccaccaacgcgtagaccccttccggatcaacgtccgtctccagcagaagcaccgccgtctgaccggagagatcctccagctcctgtccggcgtgatccgtattcatctgcagaataatgccgttggctccatttgtgacctgctttttgaccacatccatctcttccattgcggtggaaaagctccccgtcgacacaaagctcaaactgatgttgtaatcccgcgctgcctgctcaagtccctgtctgagagaagtccagcggtcgctgttgctgttctcgacaaccacggagacgcggtaggacgtctcctgcttaccgacgtttagcatattgtaaaacgcccagataatcaccgccaccagcatcaggatcaacataccaaaataaagtctatttttcttcatcctgccgttcccccttcagctgttttagtcttcctccctccagcagttccgtattttccggtgagtacgcaatgtacggaaggtgaatccgcacggtcgtcccctcatccagacagctatcaatctcaagaccatacggctccccgaagcggagtctgatccggttatgtacattgatgagtcccacaccggagccgtgcttgcgcactctgttgttctctgtcaggagcgcatctaccatctcatccggcataccaagtccgttgtcgcgcacttcaacatagacatcgtctcccttccggtatcccacaaccgtaatctcaccgtcgccgtccatggactccatgccgtaatagattgcattctcaagtaaaggctggatcacgagttttaccgtacagcagctcaaaatagcatcctccacctgaaattccacagtgaatttattcttatagcggatcttctggatgttcatataatttctggcatgttttaattcgtcctccatggagatgatcgtctttccacggcttaaggaaatgcggaacaggctggcaagctgcgtcaccataaacaccgcgtcctcataccgctcaccctcgatcatccagacgatggagtccagcgtattatataaaaagtgcgggttgatctgcgactgcaaggcgtccagctcgctcttccgcttttcttcctgctccaccagaatatcatgcatgagctcccggatctgcgctaccgtagagcgcagcgtctttccgagatgctccacctcaagcgagccgcccacatagatatctgggttcatattccccgcttcccagtccttcaccgaatcgttcaggcgttttaacggctttgcgatattggcagagacaaactggtttaaaagaataatcatcagcatggacagcgacatcagaagaatcacgaacatccgcatcccggagattcccatatcaaatgaactcatcggaactacgctcacgatcttccagccagtgtaactgatggtcttgaccgtgacaatgcgcttttccccgtcaaattcctccttgtggctgccgtcctcgtaggatgctgccacaagattgttctccgaaaacagatccgtgtagatcagcttctgcttcgggtgatagatcagttccccgctgccgtccatcagatagacatactccgacgcattgtccgtatttgccttggtcaaaagctgctcgatactgctgtaattcatatccacaagcagcacaccaagtgtcgaattgccgccgcttgtcagctccaccgcctggcttagcgatacgacccagtaatagcggtaactcggatcgtcaaacaaattctgtacatgcggcgtggaaaaatgcacgttctccatctgtcccgtcgcctccgtaaaccattcctgatccacgatgtcgaggttgttcttctccgtggcaaccggcgctgcagcaaccagtcttccgtcgttggtatagcaggcgatgctgatcagattgtccttgttcgcctcatagagaaggttcatctcctcatcaagcgagtccgtcgccagatccttgtccttaataacgctgtagtacatggcgtcggaaatacgccgcatgttgcgcagataactctccagattgattgccgtctggttcagcagctgctccgcgctctgcgtcgtcatatcttccattttattgacaaaacggttgtacagggaaatccccagaatacccatactgatgaccgatacaatcgtaaaagacaatgcaatcgtcatctgaatggactgcggcttgatgtgtttttccaggaaggaagtgaccttctgccgccactgttttactctttctctcatcctctttgcaccctatgcgccctatgcctcctgcgcagcttccatccggcttgtcttatacttggacggcgacatgccgaactgctttttgaatacatagctgaaatagttcggatcggtatatccgactttctccgcaatcacgtaagtcttctcattctgtgtcagaagcagctccaccgcctcctccatccggtaatctgtcagatagttgatgaacgtcttcccggtctctttcttgaacaccgtggaaaaataggcggcgctcacattaaggtatccacagatcgtctcaattccaaggtcagtatccgcataatgctccttcacatagtcgattgccttcgacacaaaggacttcgtcgtatcctggcgctcgttctgcacctgtttttgtaatttcagacagttctcacacagccattcccggagtgcatccgtcgactccagctgcatggcgcgtgtatacacatccccgttgccgccgaacacatcttccaggttgatctggttgttcgccccgaaacgcgacagctccgtgatcagctccataatgagaatccggtaccgctgcagcgacatcttgctacccgcaagcttctccgtaaattccgcaatcgcatccagaagcggctgttcctctcccaccttgacctttttgatgatcttctggataaagggctcctcccacggcagatcggcattctcctgagggtcgatctccgcaatattgatggctctggtattgccgtagagcacacggtaggacacggcattcttcgcgccgagataggacatctgcagttcttccggaccgctgcacacatgcccgattcccgccgtgatcttcgccttgcagacacgctttgccatcttacagatcttatccatgcagtcggtaaaacgcgtgatcgcctcctccgtgggcagctgggtaatcacaatgccatcccccagatatgtcacgatcttgctgtcatattcagaagctgccagctgctcctccgccagctttttcacggagaccgccagcagaaacggatcgatcggaagcgccccctccatcgggttggtcgtgctgatgtgcagcacggtcaccacaaaatagggaccctttagcgtgaggctgcagttttttgcatattcctcgatggagtcctccggaatccgtccgtcgatgagcgacgtcaggaaattttcctgcagcatcggaagactctccagataatattcccgaagcttgtcaatattgcgcttttcgtccagttccttgtccagattgttcttgatccgctcaaagacctcgcgcagttcgttggcattaatcggctttaaaatgtattcttccgcctcgatcttgatcgcttccctggcatactcaaattcatcaaaaccggagaaaataatgaccttgatcttctggtactgctcctttagcttccggcagagcgtaagaccatccatatagggcatcttaatgtccgtcatgacgacatccacggaaagctcctccgccatctcaagcgcttccacaccgtttcttgcatagcccgcaatgcgaaagcccatgccttcccagtccagctttttcatgatgacctggaagacctcttcctcgtcatccaccagcaaaacggaatacaaactcatattctcccgctccttttcactcgcactcattcattcaacctccgtactgatcctccatccgcttccagagaatgccgagaatcaccgtacagattatgatctccgccactgccacatagacattcacaaacaccagaatcgccatcaaaaaggtagccgcaccgaagaacagtagcagctttcctcccgccttgcagtacgcttcctcgtccttcaccggcggcttatttttcccgcggatcgcctgactgtcgtgcaaaacgatcagccggattgcataatacacacagatcacaagtaaaagcagcggaatccccgcctgctcaataatcgtatcaaccgtcaccttaaaaatcctcctgtactctcaaatctaaaatagcggctggttctaatgtcccagccgctattcattataatatactttttactttcttgctatatactttctgatatccagagagattgcgatgaagataacaacaccgattgcaatgtactgtgcgtttgcattcatacccaggtactggagagctacctttaacagctcgaatacggcaacaccgataattgcggatgatactttaccacgaccacctgttacagatacaccaccaatcgtacaagctgcgattgcttccatctcgtaaccatatccggtctggacggatgcaccgccggcttttgcaccgagcataaaacctgcaagaccatacatagctgctgctttcatgtagattaagatcagagttgcttttaccggaacaccggcaacctctgctgcctgtgggttaccaccgattgcatacatgtacttgccgtgacgggtcatgttgaaaatgaaccatgtgatcgccgccacaataattgcgatccagatcaggtagttgatgccgaggaacttaccgttagatacgttcgtgtactgctctacatagccgccgagcggtgttgcattggttacgataagtccgataccatagacgatctccatcattgccagtgtggcgatgaaaggcggaacgtttaagtaagcaatgaaaaatccggtaaccgtaccgaatgccgcacataccagcatggcaatcagtgctacgacgaatacgttgagcggctgcatatccgggaagaattttccggaataatccatacgctgtaacagcataccggagatacatgcaccgaaaccgatcatacgtcctgcggaaagatcacatcctgctgtgataacacagcctgcgataccaagtgcaatgacgagtcgtgaactcatattcatcagaatattcatgaagttgttctttgtgaagaagttatcggatgtgaatccggtatagattaccaggatgaacatgacgatgataactccgttgttgattaagaaatcttttactttctgttgatttgtctttgtcattttcgtctcctcctatctcatcagaatctcgttgcaaagttcataaccattgcctgtgtcatctcttccggctggtcgatctcgccagtaatcttaccgttacacataacacagatgcggtctgccataccaagcagctcagacatttctgatgaaatcatgatgattgccttaccctgtgccgccagttcattcatgatctcgtagatctcatgctttgcaccgacatcgatacctcttgtcggctcatccatgatcagcacatccggatcattggcaagccatctggaaataataactttctgctgattaccaccggataagtttgaaatgtgctcgttcatgctcggtgtcttgatggacagcttcttgatgctgtcatccacaactttgttcatcttcttatgatccagcacaaatcctgctttcaggtacttgttataaatggagacgccaacgttgtccttgatggacaaacagccgaagataccgttgccgcggcggtcctctgtgatgagtccgattcctgcattcatcgcatcgatcggatgcttgatctttaacttcttgccatgcatgtagatctcaccagatgcgataccgcggataccgaagataccttccatcagctctgttctctgggctccgaccagtccgccaaagcctaggatttcgcccttgcgaagtgtaaagctgacattttggaatgaatttgcatggattgagcagaggttcttgacctccatgatgacctcacctggggtattcttcttcgccggatatacgtttgtgagctcacgtcctaccatctttgcgatgatctgatcggtcgtcagctctgacgccggccaggttcctacataggtaccgtcccgcatgatcgtgatgtcgtccgcgatgcgcttgatctcatccatcttgtgggatatgtataccatcgcaacacccttatcacgaaggtcattcataatacggaagagtgcttctacctcattatcggaaagagaggaggtcggctcatcaaagatcacgaccttcgcctgctgggataccgcttttgcgatctccacggactgcatctgaccgatggaaagtgtgccgagctgtgccttcggatcaaaatccatctttacctctttcagccacttctccgtctccgcatacatcttcttgtggtcaatcaccttgagcagtccgtaattctttgtcgggaatcttcccagatacaggttctcagccacgcttctcgccggaacaggctgtaattcctgatgtaccatggcgatgccgtatttcattgcttcatccgggttgttgacctcaatcttctgcccgtccagataaacctctcccgcgtccatcttgtaaataccgaaaagacatttcatcaaggtagacttgccggctccgttctcacccatcagtgcatggacggttccgggacgaagggaaagctgtacattgtcaagtgccttaacacctgggaacgatttgcagataccctttagctccagtttgtactcagccatgtttctcctccttctatattgatacagattctgttgttatctgtgtactgtcgatgttattgtcgatgttttctaatttttctaatctggtctgtcacacaactatttcatatctttaagacaggtgcggatgcccgaaaacacccgcaccttctgcttacctgctatcaatcatcctgcgtggtaattattttaccatgtcaaggatttcctgtgcattgtcttttgtaacctttacatagtcacaaccaatgtaatactcgttggtttcaccgttgatgaagttgattgctgcatcagctgcaccgtgggactgtgagaagtgatcgttgaatacggtacctgtcatggttccggctacaacatcctcaagagcctcggataatgcatcaacacctactaagaagatatcggtacctacggtacgtcctgcagactggattgcctgtaatgcgccaagtgccattgcatcgttgttacagaatacaacttctactttatcgccgtactgtccaagagcgtttgctacgatctgctgtgcctgatcctgctgccagttaccaacctgatcggagaggcattcaacctcaagacctgcatcggtaagagcctttacggaatactcggtacgatactgagcatcaacgttctccggatcaccttctaccataacgtactggatctttccatcgccgtttaagtctactgtgtcaagaccaaggtctacgatcatctcgccctggaaagtaccggactgacgtgcgtcacatccaacgtatgtaacattccagccgttgtcttcccatctctgctcttcctctgcatccggctcacggttgatgtatacgagcgggatatctgctgctacaaccttatctgtgatggtagctgcggatgaagagtttaccgggttaacaatgagaacatctacgccctcggaaatgaagttatcaatctgacctgtctgtgttgcctgatcgtttgctccgtcaacgattgtgatattgtctttggagaagccctgctctaccagataattctcaagctctgtgcggaacagtgtcatgaagttatcggagaactggtaaatgcatacgccgactttcttgtctgcatagtcaccgcctgctgcttctgttgctgctgctgccgtatcggaagcctcggtagccggtgctgctgcatcggttgtcgtggatgctgcgttatctgttgtggtcgtctcgccagaagaacttccacatcctgttgccattgttgcaaccatagtagctgcaaggattaaactgattactttctttttcatctctgaaaaacctccctttttgtattcgtaactccttgttacattatgcattatagcaatggaggtctgtaaagaacatacaatattcttctctttttcttgaaaatacttctgtttcttttgtgtgtttcgtataattttatggtttttcgttttttcttcttgtgcatattttgcagatggctgtttttgaccggttctgtttcgtgcaaatatacaaatgtccctgtgtgaaagacaacgcttccacgcagggacatctgctctgcttcgactttatacctattattatatcatcgttgtgttccgccttttgcgtaccggaagttccacaggaacttctaagatgaactcgtcatagttcattgtagtaccttttccgcgatcgcaaccgcatcgcggatacagtccggacagctccgcaaaaccacgccggtttccacacccttcaattccttacagacaagcgcatggttcttctcggcaaactgtctggtgatctctctggtcagctgataggttgccgccttggtcttcgggttcttcggatcggcacagctgttcttgaagcccgcaagcatcaccgctcctgagaccgctccgcaggttgcctccatgccgcccatgccgagtccgaatccttccgccgcggcaaacagcgtctcttccggcacgccgatctcctccgcaaacgcacacgccaccgcctgtgcacagttgcatcccctgtcatgcaattcgattgctttttcctgttttgtcattttataacttcctttccgttccttataaaatccttataatttgcctgtatgctgtttctgtgaacatcttatcacaacttatcacaagaagtaaacaaggaggattccagaacgtatgaatcagacaacaatcacaaaacaacggggactctcagactttgcgctcaaatattttgccatggtctgcatgattctcgaccacattcactattttttctcatttacagggaagatcccactgttcttttcgtggatcggcaggcttgccgccccgctgttcctcttctgtatcgtggagggttttcttcacacgcacgaccggaaaaaatattttctgcgtatttacgccatcgccattttcatgggactggtgcagttttccttctataatattgcatccggtctcgtccggccggacggctttttcccgcagaatcagatgcttgcatccttttccgtcctgctcgtcgttctttggggcatcgaccggtgtcagaaaaaacagtggatccggggactttctgccatcctgattccggtctttctgccctttcttctgtacgggctgttcgccgtatcggaagcctttggcattccctacggcaattttctcttaaaccttctggtgtacagtgtcctgccctgccacactgcgatcatcgacggtggcaccgccacactgctcggcggcgtgattctctacctgacgcacagacaccgccgattgcaggcaggtgcctttgcacttttcgtgcttgcgtgggacatcctgcccgtgctgctttttatgcccgcaggaacttctgcctctttcttttttaccgatgcttatgagtggctggaagtttttgccgttatccctatgttatgttacaatggaacccgtggacacggctccaaaaagctgttctactggttttatccgacgcacatttacgtgctgtacgcactttcgttccttttgtacctgaccctttatggaatgggttcttgatagaaatgaggtttttatggctcacattctcgcaattgacgatgatcccggcatcctcgcgctgattgaacatgcactccgccgggaggggcataccattacctgcatgccgcatgtaccggcggatcttgcggcgcacctcgcagagtatgatctcatccttctcgacgtcatgatgccgcagacggacggctacgaactctgcagcgccatccgcgacgacacggactgcccgattctgtttctgaccgcaaagaccatggaggaggacgtcgactacggtttttccgtcggtgcggacgactatatcaaaaagcccttctccatcgtcgaactgcgtgcgcgcgtcgcagcgcatctgcgccgggagcagcgtgaaaaacatcactgcctctacatacagggcatccgctttctgctcgcctcccgcgaagtcgcagcaggcggcgtcacgctccccttcaccagaacggagtatgagatcacacttctgctcgccaaaaaccgcggacagacattttccagagagcagatctacgaagcggtcctaggatacgacaagacaggcgatgagtctgctattacagagcatattaaaaatatccggaaaaaattcgccgcagtaaatatggcgccaattcagacagtatgggggatcggttatcgatggaacgcatgaaaaaaaagaaaaaagaaatccggctgcgcacattttttgtgcgctttttactaaagcttgtcgccgcggtgcttctggcgttcctgctgtggcttctccagattaccgtctccgtcggtacgggtctgatcctgcctgcgaacgccgccgaaaaagaggctcttgcctaccttcacaccatcggtgcacatacagacatcgtgtcttccgggattccatccgcctgcagctacgccatctatgacacatccggagcgcttcttgagacggacatgtccgattccctccgcggaaacgcggatcttctcgcgctttccggacaggattccctctccgcaaatatgcttgggcgaacctatgttaaacgccagaccgacacccggattgtggtgctcacctacgatttccggtctgcctttgcaaatcccacgctccggcgtctctttccgagcgctgaactgctggaagtgtttctcctgctgttcctgcttcttgcagcttttgtactcgtcatcacgcggcaggcaaaatacctgtcgcgggagcttattcatctgcaggaagccgccgacgaaatccgcaatcagaatctcgactttaccatccggccgactgccatctgcgaattcaaccaggttgctgcttctctggacgcgctgaaatccgaactttccgcctccttaaaagagcagtggcacatgcagcaacagcgcagacgtcaattttccgcgctcgcccatgacatcaagacgccgcttacgatcgtccgcgggaacgcagaacttctgtctgagacagcgcttgatccgacgcagcaaacctgtaatcggtttattctggaaaatgccgcgcagatccaggactatctgtcgagaattatcgagctcgcaaagacggatgatcccgctgcatgttccgcagagtgccgttttcaggcgcagcttcacacggcatcgtttttcgacgatctgctcgggaatacaaaaagtctcggtcagaaaaaagaactgcatgttcttttttccaccgagactcttccagccgttctgccactgccggaacatccgctgcggcgtattttaaacaatctgctcgacaatgccgtgtgctactcaccgcacaaaggaacggtcactttagatgcctccatccgcgattatagggatgcacccgagaaagaaagcacgctctttctcactgtatccgatgagggacccggcttctgcgaggacgccctgctctacggcacggaagccttttacagggaatccgccgaccggaatgacaaaagccacttcggtctcgggctctccatcgccgaccagctcgcccgcggacttggcggatcgatcgctctgtgtaatgccccggcaggcggagccgtcgtaatcgtaagacttcctctgaccgggcagatacagcgcgatgcggaataaatcctattctaccggaacggtccagccgtacttatccggaagcttgccccactggataccggtcagtgtgtcgtacagcttctgtgtcagctcgccgatcttgaaatcgttgatcgtgacaacatcatccttgtagcggagttcaccaaccggagagatcacggctgcggtacccgttccgaatacttcctctaaggttccgtcatgtcctgccttcatcaggtcatcgacggataatctggtctcgtttaccttgtaaccccagtctctcaacagatgaatcatggaatctctggtaacgcccggaagtaccgtaccctcgatcggtgctgtgtagatctcaccggcgatcttgaacatgatgttcattgtaccgacttcctcgacgtatttgcggtgctcaccgtccagccagagtacctgggagtaaccaagcttttctgcctttacctgtcctaagatggagcctgcatagttgccgccgcacttggtgaatccggtaccgcccttgactgcacgcaccagctcgtcctcgacaagaatcttcaccggattgatgccctctgcatagtaagcgcctaccgggcagcagataatcatgaatttgtaagcggacgccatatgtacgccgagcgcagcctctgttgcgaacatgaacgggcggatataaagagaggtctccggctcagacggaacccagtctgcctccacctttaccagcgcttttaccgcttctacgaacatatccaccgggaactccggcatgcagagtctcgcgttggaattgatcattctcttcgcattcatctccggacggaacagctgaatctttccctctgccgtgcggtatgccttcataccctcaaatgtctcctgcgcatagtgcagcgtcacacaggcaggctccagactgatcggtccttccggcacgattctcgcatccttccagccgtcttccttcgtccagtccatgacgaacatgtaatcggtcatatacttgccgaatccgagatgtttctgatccggcttctcctttaatacgtctctttttacaaatctgatatccattatgctaccattcctttcccgacatataaaattcttgaaatcaattatgatactttcttttttcagtgtcaagattattccaaccgcttatgccgctcatgattgtaagttatatattagtcatcttcccatatccatatggaatgaaaaacgccgcaaaaaagcggagcaggatcttttctcccgctccgccatcggagtctcttttccctattttaccacttttttcaacggaatccagagaataaatgcatacacgcttccgatcagggaagtcacaagctgcgtcacggaaaaggtcgtctggaacactgccatctttgcctccatcggtgccggcagaaggttcggaatcagaatcagcgagatcacaattcccatgaacagtgcctttacgacagatcctgccgccatgccggcaatcagtccgccgtttcctttgcattttttcgtgaccagtcccacacccaggaccagaagggcattgcccgccatgatacacggcatgatcgccggaatggcaccgatgatcgggcttcccgtaataaagaatgatgtgaccggcgtgatcacagagagaataatgccgcagggaattcccacacttaacaccgctaagatcaggcatgcattgatgaccggtccggtaatatagacgctcgtgttcttaaaaaactggctcacgatacagatcgccagaagaaccgctgtcgttgtgatttgttttgttgtgattttcatcgcttcctccttctgatgcagcactccttcgcagatgtaatgcactctcccgtcactgcaccaaagcaagcataatacttctctctcataaaatcaagccgtcactccgccagcagattctccacaagtgcgcagaactcgtcccggctcagtccttccgactgcacattcacggtcacaccgtttttcttataggtcgccagatacccgtccgtgaacgttcctccactgctgcccgccggataatgtgctgctgtcaccttcacaccggaaaccgtcatcggctttaatccgccggatacataggacgtcatctcccccatgtccgttgagcgtgcgcgaatggtaaaccatcccgctgtctcactgttctcataacgcatgacacagttgtcatcgatcacattgccatctgcatcatagccaatctgatacgttttctcctcatccgtctgcacatagccatccggaattgcatccggaatcaccttgattccgtaatagttctgaagctgttcctctgtgagtgaaaccgtcttcgccgcttccgccccgcaggcaatcgatgtctgaagttcctccacttcgttaaaataccagtcaattcccgcagcgctctccggctgggcagcctcttgtataccgtcgccatcctccgctgcgctttgtgccgccgcttcatattccttcgcactctccgcggtgccgtccggcgttgccgcgtcagatgtcatgataccgtcggatgccgcagtatcataagcttctgccgtttccgcgctctccgtctttgccatgtccgtgcgcgccgtactctcatactgctgccatattccgtaggaacctccgatcaaaagaagtgccacgcaggcagccatctgcataaaatgcttcctgcgtgctccgagatagcgtacgtcctccgcttcctgtatgtaggcaggatccgcttcgccgagcgcatccagtaaatcgtccgtcttcatattttccgctcctttccgccgctatgaaagcagcccttcgcgttccagatgtctccgcagttttccccgggaccggtacagcgaagattttaccttactctcgctgaccgcaagcctcccggcaatcgctccgatgccatccatataccagtatctgcgcatgaaaataatccggctctcacggtctaacccctccaggaaccggttgatggacgccgccagttcctttcgctctatctgcgtcagcggctcctcgcccccggcgcagtcatgcagttcttcatatatatccggcatgacgcctccgcctctcttttcggagtgctttctgcggtagcagtccagcgacagattgcgcgtgatcgcacccagaaaagccgccagaagatgcgggcgctccctgggcatggaattccacgcgcgcatccaggtgtcattcacgcactcctctgcatcctgcgcatcatgtacaatgttgtgcgcgatgctcccgcagtaacgtccgtacttctgctgtgtctctgcaatcgccgtctgatccctgtcccagtacagcgctatgattttttcatcctccatgccttctccctctcagttaaaagctctccaccgttccgatgaacaccggaataccggtgtccttctccacgatcgcatataaaaacggcctgtctaaaataatgcgctccggctgttcaaccattgccgtctccttgcacatctccacaaccgtggccgctccggctttcgttccaagcccgtccacatcgatgtgggtcttgtgcagcaccctgctgatgctgatatttcttccgtccgggcagtaccccattttggaaaaatccgcctgttcctcatcaaacgcgagcggcattccaagcgccgtgagcgtatcttttagttccagatcggtctcgcctgtaaattgcggcagacccgtctctatcattgtatcattttcctgccggattgtctcgtgaaacgtttccccgtccagttcttccagccatttgctcagtgacagtccctcctccggaagcagcgccacaaagtcatagccctccttgtaagcccggcaaaagccctttgcatgttccatggtcagatagcggtacgtggtatcgtacatcatggaaacctcctgcccgcttccgtcctccgcataaaatgtggcatcctgtatctggctctcatcatagggcgtttcccactccgcatcaaacgccaccgcattcaccaggtacatgaccgcaagctccggaatctgatccagaatctctgttatcatgccgtctgtctcctgctccaccaggcggttgatgtcccggcaggtcgtctcgtcaaacggggcgccaaagacttctgcgtcatacgccgtttttacggtgtcaaggaaattctcatccggcacaaatacatcgtccgccgtcttcacccacaccgaatcagacatgtggaatctggcgccctctgcatccggcaggctcttgcagatcctgccaagcaccatactgccatcctccgccgacattcccgggtacaaaaccgctcccatctgctgcttcgtgtcgccgtccgctccggtccgcgccatctcgagcgccatcatcacggaaagaggacacaccatcgtattcttcgcgtcctcgccgttctgcacctgctttctgctctcccgcagcagatttaaggaaaactgcgtataggaatactcaaatgcttccctgatagcaccgagatctttttcttccattgcagtatcctccgttcctgtatcttctgcctgtcctgtctgtccgtttgctccggttccttccgtctgaccttcctctttggtcccgtattgtccggtaagatcagtggttgtaccggacattccgctgttcgcacagcctgtcatccccactgccatcactgccgcaagcacacctgccgtcacccgttccattccttttctcctcataagcttctccctctcttttctatcatccggtttttgtctttcatataataagacgcaaaaaaccggaaacggttgcacccatttccggtttttgtaaaaattttctatctcacatcttctgttctctctacagccttaaatactcaaacgcctgatagacatccagcgcaccgtacccccactcccggttcgggtaccccctgtcctccgagcgctttgcaccgcggatgagcatatttttgatcgcggcgttggacatcactggatcgttctgctgcaccagcgcccactgcatgatctgcgcgaccgcccctgccgtcaccgccgccgcggcgctggttcccgtgtaggtcacataattttggcgcagccccggtccatatacactcaccgcaggtgccgcaaagtccggcttgatctcacccgccaccgtgtagccgcgcccggaatccgcatacatgctgttgttggaaacctggtacccgccgaccgtgatgacctgtgccgctgtccccggcgcagtgagcgtcgtgtccggattggatcttagaaaaatcacatttccgtccgtaagcttctgcatcgggagccacatgttatagttgccgctcacaagattttccggataaacccgcacaatccaaagccccttgcgcacatccgaaaagcgcagatagatcaactggtttgccgtctccttcgtctcaatgcggtaatccaccgacacggtcgtcccctcaaagacaaaccggaaggtctgggagacaccggaacgcagcggcactttcggaagccgttcgcccgtcggcgagatcacagatatcgtgtacagttccggcgcgcccgcccacagctctatgaaaaagcccgccatatcctgctccacgctgatctccacatcctcatattccatctcacggcggatcgccccctgaaaatggtgcctggtgttcgcctcgtttcccgttgctgtcacaatcgagcgtctccgcctggtgctgatatagttcaggaaattggacagcgggccgtccgtcccgtgtccccccatgctgttgccgagtgcaagacagatcacaagcggcatatttaacacatttgcaacgtcatttaaataggataccgccatcatcaggtccgtctcctgataggcaggcactccctccggcacgaagaaaaattcccgcagatagcgctttgcctcttttagctttacaacggcaatcccggcgtttggcaccgccccgataaagccgttcgggatatcctctcccccgcacacgactcccgtcacgaacgtcccgtgcccgttttcatcgcgggacggcaccacatcatacggctgctttttttgcaatgcttcatcaatctcctctttgcggtactctgcaccgtacaggattccctccggcggcgttccatcctgtatcgtctgatcccagatccttaagattctgctgctgccgtccgaataccggaacagcgggttcgtgtaatcgacgccggtatcaatgacgcccaccagaaccccctcgcctttcagtgcaagcaccggctgattctgcagccgggtgattcccgatgcatcgagcgccgtcgtatcgagcagcgcgtagcattttggtatcgccgtgtaggtataattcccgatagaaagcggcggcagtccctctcgcgggtagaaaaaaatgtcgtaatcctccgcgatgcgctgcacgcatccgggcgtggacggaacctctgcctccaccccgtacggaatcaaaaaatcataatactcctctgaatatacctgctccctgcaatctgacataaaaaaactccggtcatccattgctttcttaacaatagatgccggagtatatgaatttattccatatttatcaattgctggcagcgatctgcggattctccgtactcccgataccgatgcagccgcgcagcgtgatgaccggactgcccttcttctccacatagtctttcgtgatcgtgaccataccgatgttgtcgtccttgggaatctcatacatgatatccagcatgaactcctcaatcaccgcacggagcgcacgcgctcccaccttcttctcttttgccttgtgtgcgatcgcgcgcagcgcatcctcatcgaacgccagcttgacctcgtccatggcgagaagcttctcatactgctttaatatcgcgttcttcggctcctgcaaaatccgcaccagcgtatcttccgagagcggctctaatgtaaacaggatcggcagacgtcccaaaaactccgggatcataccgaacttacgcacatcctccacggtaaccttggagagcaggttctcgtccttgtcatactcatcctttaacttcgcgcggaatccgatcgaagcctcctgattcagacgctccttaatgatctcctccagctccggaaatgctccgccgcagatgaacagaatattcttcgtgttgaccatcgtcatcggcaccatcgcgtttttgctgctggctcccacaggcacctcgacctcggcgccctctaaaagctttaacattccctgctgtacggattctccgctgacatcccgctggttcgtattgcgcttcttcgcaatcttatcgatctcgtcgataaaaatgatgccgtgctccgcacgctccacatcattgtccgcagccgcaagcagcttgctgactacgctctcaatgtcgtcgcctatgtagcctgcctccgtgagtgacgtcgcgtccgtgatcgcaagcggcacatccaaaagccgcgcaagcgtcttgaccagatacgtcttgccgcagccggtcggtccaatcataagcatgttggacttctcaatctccacgccgtccttctcatccgccgcaatccgcttgtagtgattatagaccgcaaccgacatcaccttttttgcctgctcctgtccgaccacatattcatcgagcgacgccttgatcttgtgcggtgctgggatcttcttaatgtcgataaccggctccgactgcgccttcggttttttcttcttcagcttctgattgttcggcagtccgccctgcagatccgacagattgatcatgctgatgttcggaattcttcccatgttcatattcatcatatcatccatggaaaaaccgcttccgttcatgctgtcaaacgtcttctgcatacagtcctggcagatgcagatattgttcggaatacggatcatctttcccgcaatatgttccgggcgtctacagatatagcagatgtcctcatactccgtgtcctgattctgatctgtgtcatccgaaacggaactctgcattacctctccggtgcctgatgtgctctcatgctccgccacatcttctgcacggggagcctcacttcccgtctgcgcaccgtgagccgcgtttcccgccggcacaccgttatccgcgcttcccggctgtctgctgcctgcagttcctgtatttgtatctgcgcccgtctccggcgcgtcatctataatctctctgaaatcattgtgattcatactaatcctccattcttgcgctgcttctaagcgcatctcaagtttgtgcgaagcacaaatcttgcgtgtgaaaaatcttatttttcacactaatatcccctattcgctttctatcatgaaatttaggttcattataatgcaaacattgtttaatcacaaggaaattacggagatttcatagttattttaggaattcatcaaaaatggcgaaagcctcttttgctttcgccattctctatttccctcatccgtaaaacgcgctctatctgccgtttccgttattatctgtggttccgttgttattattgtcattgccggtcagatcatccacaccattctccactccgttgatgacatcctttccagcctcaccgacaccgtctaccacgtcgtccacaacattgccgtttccgttattatcagctgcgccgttgttgtccatcgcaccgttatcgtttaaagtttcattggtatcgttcactgtgccgttggttgttccgtttgtgccgttggtcgttccgtttgtgccattggtcgtgccgttggttgttccgtttgtgccggttccattgacggtgctctccgtgccggttccgttcgtcgtatcattgacgttgtcattgttcgtaccgcaggcagccatcgcgctcaccgcgaaagtaagtaccagtcctgcaagcagtgttctccactttctcatagtcatattctcctttttctcagaatcacttctgttttcaaggatagtatgaccctggcgctttccttttattcccgcatccgatgtttttcttttgaattttatttttgaaaattcaatcttaagatttgtaataaccaagctctctcgacagttcttcctgtacttttttcacatccaccgcaagttccctgacgcgctctctcgtcatgcggctggtcggtccagaaatactgaacgcgtattttacctctttctggtagccgtgcaggcaggctgcgatgcagcggacgcccttttcgttctcctcatcgtccagcgcgtagccattctgccgcacttcatccaatacttcctgcatctgcgagaaatccgtgatcgtcttgtccgtctttttctcaatgatactctcgttccagatctttttgacttcctcgtccggaagcgtcgccatgatcgctttgccgacaccggagcagtacatcggatgtaccattcccacatgggacaccatgcggattgttccgaccttcgcctcgatcttgtatatatataagatatggttgccctcgcgctgcaccagatgcaccgcttccccggacaggtccgagagacgttccatatacggctttgccacctgcagaatatccatccgctcaaggatctttcccgccatgttgaccaccttataggaaagcatatatttctgcgtcgcctcatcctgctttgcgtatcccatataaataagagacattaacagtctgtgtacagtgctcttgtgcagatccagcgccgtgctaagttccatcagtcccatctccccgtggtccgcaagcgtctccatcacctgaaaaatacgctctgccgactgtaccggatttttcgcttctctctcttctgccatagtatctcccatgctgtatctcagtcagtttcatcattcaatctgccgttccgtattacggaacgaccttgttatcatatcatgaccgccgcccgaaagtcaactccggaatctccgctgtcccggtgttttgttttatggaaaatacatgattttgtttcttgaatcggttgacaaggtttttccacatgttataataattttgtaccattacatgaaacatagttccgcattgtggaacatgaatgataagtaaaaggagaagaatcatgaacaaagtattagaagagttttccaagattggtattatcccggtcatcgcactggaccatgtagaggatgccgcacctctggcaaaggctttatgtgacggcggtcttccgtgtgctgaggttaccttccgtaccgctgctgctgaggagtccatccgcatcatgtccgagcagttcccggagatgttagtcggcgcaggtaccgttcttaccaccgagcaggttgaccgtgcggtaaacgcaggtgcgaagttcatcgtcagcccgggcttaaacccgaaggttgtaaaatactgcgtggacaagggtattccggtaactcctggctgctcaaacccgagcgacgtggaagttgcaatcgagcttggtcttgaggttgtaaaattcttcccggcagaggctgctggcggactgaacatgattaaatccatggctgctccgtacaccaagatgaaattcatgccgaccggcggtatcaacgctaagaacctgacgaactatcttgatttcaagaagatcatcgcatgcggcggttcctggatggtaaacaaagacatgatcgcagcaaaggactgggcaggcatcaccgctctcaccaaagaggcagttgctaccatgcttggcttcaagctcctgcatgtcggcgtcaacaatgcatctgaggaagttgcttccaccgagtccgcaaagttcgcaactttacttggacaggatgtcaaggttggcaacagttccatgttcgttggttccttaatcgagatgatgaagaatccgggccgcggaacacacggtcacatctgcatccagacaaattatctggatcgtgccatctatcatctggagaagagaggctttgctttcgatgagtcttccttcaaatacaatgacaagggtgagcttaccgttgcttacttaaaggatgagatcgccggattcgctgtacacttcaaccagaaataaggagaacatcatgacagatcagaattgcgcatattgcatggaaggtgatctggtagccgcattcggcatcaagatctgtgaacttccttcctccaaggtatatctttttaaggagcagagccacaagggacgtgtcatcgttgcacacaagaagcacgtgagtgagatcacggagctgaccgccgaggaacgtgccgcttacatcgaggacatcaaccatgttgccgaggcactgcatcaggcattccatccgcagaaagtgaactacggcgcttatggcgataccggtcatcacctgcacttccacctcgttccgaagtatacagacgagtatgagtggggcggcgtcttcgctatgaatccacagcagaagttcctctcggatgcagagtataccgcactgatcgaggagatcaagaagtatctgtaggatatgtatttccgttggattttatgaaaccgaggcaaaccgcaaaggtttgcctcgttttttgcttatgctggcacttgcaagagaaaagcgcatgaaaacggtaatggcaaatcattttccacccttggcatccagcattttaccggcgtattcctgctccagttcttctgccagatacacatcgctcatacagtgcatatccgatacgccatcacgaatcagttgatatacctcggaatgataaaagaattccaatgccgcatccagtgaaattccctgccgttttgcaaaacacgcaatgacacggctatattttttttgtagtaaaatcggatttgctgtcatacaatttcactcccttcaaaatgcaggagagacaatgctctctctgtgcggaaacaaatttgcacattcggtttttcataacgcagacgtttgatagcctccgccttatcaatcaatccatcaaaaaacaattccaccgtattaaataccttatcattggcaacaccaccaacaacgagatcataatctgtcgcgtcttttccaaaagaaccatggtagagaatcatacttccacgcccctttctttcatcacattaataagatcatctacgatatattcccggctctgtgtatgcagcacttcatattccggcacaatataaccgctcagaatatcacttttttcggtaaacgcctgatacacacgctctgcatccatccccagttttgccgctacattttcaatacaaaatacgacaaactcgagttcactgtaatttttgattttttcatccgccatcataagcaagctctcctttatgacaatatgaaaaacagctttctcttcttatcactgttagtatagcacttcatatccatatgctcaatcagattacctctaaaaaaggcacccgggtcattacgacccaagtgcctgtatatcctgatccttttgcgtaagcccctaccggtgcgtatcccacagtccgcagtaggcatccaccgggtcctccccgataaatgcgtcgctgccgctcatcagcttctcgatgagcgcatcaaacgtctgatccgcgctgtcgtaagtgttgatatacgttctcgcctgcggaatgtctgccagtacgaacggctgtccgcatccgatcacgataaccggaagttcatgaacataccacgggatctctccgccgcccttgctcatgccgaagcccggtcttgccaccggctggaaaccgcctgcaatgtccaccagtgtgatgatcagatcctgattttcgacgaaatccttgatcggcgtctttccggcaaagtacatattgatgtccaccttttctcctgctgctgcacgctttgcaagtgcgtcgagcgggctctcgtagataaatgcttcaaagcccttctcgatcagcttgtcacgcagacgctctgccgggctcttcttgccgccgcccatatattttgccatcatggttcccatcacgcccgcggataatccgctgacggagacgatcatgatgcgcttgtaacggctcgggatcatcggaagcacatcctcgtccttgtattttacgagagtgattcctttctcggagatttctcttgccatcgccttgtgctcttcgcagccaacgacctgctccatcacctccaccggaggaacgatctcatttttcgcttttttgtgcagtcccatgtgtgctttcagagcaagaatgcggtgcagggcgtcatttaaacgctcctcggtgatgatgccgttctcatagcccgccatcatgcttgcaaaatcctcatccatctcattgaaaaaaaggaacatatcgacaccggctgcaatcgtgtgcggaagcatctcgctgcgcttcatacagcaggtcagtccgaccatgtgggaagcatcggtcagcaccataccattaaaaccaagctttccgcgcagaagtccctcgatcagctccggcgaaagggttgccggcatgatgtcctcatccctgattcccgggttaaaatgtctggtgtacgcaggctgcataatgtgtcctgccatgatggcttccagaccgttgtcaatgaggttctggtatacttttccatagcttgcatcccactcctcacagctcatgtcattgacgctgtctgccacgtgctggtcgcggaagtccagtccgtcgcccggaaaatgcttcgcagcacagcagaatccctcattggtgtgtgcgccgtccatatatgccttcgtcatctcgcacacgcggtccacatcgtttccataggtgcgcagtccgatgaccgggttctcccagttgtagaggatgtcgctgaccggggcaaaggagagattacacccgatcgccgccgcctctttgttggacatacggccgagctcgtacgcgtatctggcgtctcttgtcgcaccgatcttggtctgctggccgatcatggttccgtcagtgcaggcgccgttgccgccattctccgtgttgcacgcaatgataagcggaatcttgctgttctcctgaagaatccggttctgctcacgcacctcggcaccggttgccgggttgtagcggataccgccgatgtggtacttgtccactgtcatcttcagatactcttcgtctctggaggatcccatattgaaaaaaagctgaccgatcttctcctcggtcgtcatacccgcgatggtctcttccacccatttacagtcctcatcggacaggtaaaacggttttgccttcatatctaccatattaaaatatccctctctttctcactccgaatcggcatgaacaccgagattctgctcgaatgcctgattcagttccttttgatattccgcatcaaagcttcccgcaagaagttttggaaacgcttcctctaaaagacgtttccagctctccccctcatgtccgaccagaatcggatagaaccggacgccgtttttctctgccgcgtcccggtctcccggtgcatcgccgaccatcagaatccgcccgggctcataccccatttttctcaattcaccgatgcagaaagccttggttcccgcctcctgcgtcagaagcgtactgcagtcttcggcaagatgatgtctgccccattccgcctcgaccgcctcccggttcgcggacgacaccgccgccagatccgcctgttttgccatcgcatccatcgcagacttcacattcggaaacggccggtcctctgccggaagcgcatggatcgcgcggttggtgcggatgctccagagcagcgctttttcaaaacacgggttatcactcttctgcgtcaccgcaagcagcgccgggttggagagctccttcgcctcttttgtccatgcctcatactccgcaagtccctcgatgttaccgagacctctcttctccacctccgcgagcgccagcgccagtcccttaaaccggttgataccgcgcgtgatggagtagaggttgatagaaagccaaagctccatgcactccgcttcatgctccgtcagtccgaatgttttgatccactgcggtccgaagcaggttctgtgctttacctccatcgtgtccatcgcacagccgtcgctgtcaatgcacacgatacaatcactttttttctgaaaatcaaaataccccattgttccacctcatgtattgccgcctcttccggctcctttgcaagcttttatacgccggagtatgccgcaaatgctccgtcgatcggaatacatgcgccattgacaaatccgcttgcctcctcacatgccaggaacaggacggaaccgatcagttcctccacctcaccaaaacgatccatcggcgtattgtttaaaatcttgccggttctggctgtcggtgtcccatcctcattgaacagaagctttgcattctgctgtgtggagaaaaatcccggtgcgatcgcgttgcagcggatacccaccttggaaaaatgcactgcaagccattcggtaaagttggaaattgccgcttttgcaccggagtatgccggaatcttcgtcaacggtgtgtaagcgttcatcgaggaaatgttgatgatgctcgcaccttttttgttgaccatatcaagcgcaaatacctgtgtcggaatcagggtacccatgaagttcaggctgaatacaaaagagacaccgtccgcatccaggtcaaagaatgtcttcatctgtccgagatcctccggcacaaaatactcgtcgtcggtcgtcgctttcgggttgttgccgccggcaccgttgattaagatatcgcaggttccgaagtccgcagcgatctggtctctcgccgcctgtacgctcgctttctcaagcacgttgcacttgtatccctttgcaatatagccctttgccgtaatgtcatccgcatgcttttttgccgcatcctcatttaagtcgagcagcgctacctttgcgccggtcattgccattgcctccgcaagcacggagcagatgactccgcccgcacctgtcacaacaaccaccttgcctgtcagatcaatctgaaatggtaacttcatgttcgtcttcctcctgatttttatttttatggtatttatttttctgattcttatttttactttgaagccttctccacagcctcaaataatccgttgatataggttgctccaagcgcacggtcatagagtccgtagcccggtcttccggtctctccccagatcattcttccgtgatccggtctcacatatccggtaaatccattgtcatgcagcgctttcacaatcgcatacatatccagagagccacagctggagagatgtgcacgctcctcaaaaccattctcaagcactgcaacgttgcgcagatgtgcaaaatgaattcttcccattgccgcatattttgccgccatcttcaccacatcgttcttgttcgagcagccgagggagccggtgcacagtgtgatgccgttgtgcggatcatccacaagaccgaggaaacgatcaatgtttttctcgcaggtgatgatgcgcggaagtccgaaaatgctccagcacggatcgtcctcgtggattgccatgttgacgtcgcactccgctgcaaccggaatcactctctccaggaaatacttcagattgttccaaagatcatcctcagacattgcgttgtactctgcaaccacctgctttaactcttctctggtgtagcttgcatcccagcccggaagtgtcagatcgctgtcactctgcagcggattcacagcatccacctgctcctgataatataccagggaggtcgaaccgtccggcagcacgtggtcaagctgtgttctcgtccagtcaaataccggcatgaaattgtagcagatgcacttcactccggcttttgccacacgtctgatgttctcgcagtagttctcgatgtagcggtcgcggctcggcttgccaagcttgatgtcctcatgtaccggaatactctcgataacctcaaaatgaagtccggcatcctccacctgctttttcagtgctgcgatgctctcctcgctccacacctctccgaccggaacgtcatacacagccgttacgatcgagtgcattcccgggatctgacggatgttctccagtgtcaccttgtcatctggtccataccagcgaaatgataatttcatagtttcctccattctgcggaagcttgtttccgcgcatgtgatatttacttgtatacatgctatgatattgctccatgtacgtttctttgtttctttttcttgactatatcatgcttgtatacaagcgtcaacatccatctttctttttttctgttttgtataattttttgtatctgttttgtctattattcacaatttacaccggtttttccgcaggttctgctttttctcctgttgtatacaagtgggtattccccggcagattttccttgtttcatcttcttgcgccgtgttccgcgcgtcttaagttccggaaggactttttatcgaaatccgccagaattccgtctactgtcctgcactgtttttcatcctgccccaagaaacagcgttcccgttttttcccgatcctatgtatacatatgtaaggtgcatgtcccgggctccggaaaaatagattgtaatttgttccattgggatttatattagaaatatgttcacattttgaatggtaagaatggacaccaaattgtccacagaggagcatgttatgaacggaaccagacataccggcacatccgttgccgtttataaagatttaaaagaacagattcttcatctggagcttccgccgggatctgccatcagcgagatcgacacggccgccgcattccatgtatcgcgcaccccggtgcgggatgcttttaaaatgcttgagcgcgaggggcttctggaggtccgcccgcacatcggtacattcgtctccctgatcgacctcaacatgatctccgacattctctatctgagggagaccttagagcaggcggtgttaagagatctgaccgcagggtacgacaaatcccaggaattccgcatccgcctgctgttgcagcgccaatgcgaacttctggaacaggatctgcccgccgaggaactcggccgggccttcatcattaacgacaacgagttccacacaacgctctacgagctcgccgggaaacgtaccgtcatggattttctgaccggagtgagctcccagtacgagcgcttccgcacctttttgaatctgggcgaccgcgacaatctactgcggctgtacaacgaccatatcaaaatctggtcgtgtatctcctcgcgggattatgaggggctctcggatgtagtttcccatcacatctacgacggcttcaatgcaagcaccgagatcatctccaggcatccggactatttctgtccgtttcactagaatcttttagagccggcaatccgcaggcggattacgcctgtcggattgtctcacagacgcggtcccactcctgttttaatgacgtcattttctcttgcagctcttcgcgcgttcctgcacgtaagagcgcaacaatcgccgcgctctgctcaaaaagtcccgtaatccccagcgttccggtcagtccttttatggcatgcacctgctccaacagctccgcttcatcctgctgctccaatgccgcccacgccgcatccatatgtgcatcctccggcagctttcgcagatatttttcataaatcgcctgctttcccataaaccgtgccaatgcggcatcataatcgattccggccgcgcgcagtgcgttctcatccatggcagtctccccctatcacgctttttatgattaagattctactaccagatgtaccaatacgcaaacacttatttcttcattttcggctggaaaatcaggcttgccagatagccaaacaccaacgccgccgatatgcccaccgcgcttgcctgaaagcctcccatgaaaattccaagaaagccatattgatccaccgcctctttcacgcccttccacaatacatttccaaatccgagcaacggcacgctggcacctgcccccgcaaattccacaaacggttcatagatctgtatcgctccaagcagtgtgccaagacacaccagaagcaccatgatgcgccccggaagcatttttgttttttccattaaaatttgcaccagcgcgcagatcagcccgccaacccagaatgcattgacataatccatagcatttttcccctttctatcctgcatgctcaatgacgaccgcatgcgcaattcccggcactgtcattccctcattaaaggaaacggtcgagagcagcgctcccgtcgggacaaacaggattcttttccattttccttcctcgatctgccgcataaaatgtgccgagagcgtcactgccgcacacccgcagccggaaccgccggcacccgttccctgtttgtctgcatcgtagatctcaatcccgcagtcggtgtggatgctgctgatgtcataccctccggctctcgtcagatcccagagaatctcctgcccgacttttccgagatcgccggtaatgatcttatcgtaatccgtcacgtttcttccgaaatccgacagatggcggcagatcacgtcactggcggcaggtgccatggccgctcccatattcatcgaatccttgatgccgtaatcgacgatcttgccggtcgtgatccccgtgatgcgcgccttgcttctttttttcccgagcacataggcgccacttccagtgaccgtccacgtcgccgatttcgggcgctggttggcatattccagtggaaaacggaactgcttttccgcgctggcaaaatggctcgacgtcatcgccacaacataatccgcataccccgccgccacgcacatcgcgcccaatgagagcgcttcgccacaggtactgcacgctccataaagtccgaacagcggcacctgatagtccatgagcccgaaggatgtcgcaatgttctgcccgagcagatcccccgaaaacagataacggatgtcctcggttttcaagcctgcctttccgaccgccagcgtaaatgcttccttctgcagggtactctccgcctcctcccaggtgttctgtccgaacttgtcgtcctcgcccaccacgtcgaagcggttcccgagcggtccttcgccctcttttttccccacaatactcgcactgcttatgatgtaaggagcctccgcaaacgcgaggctctgcttcccgacctgtatctccatatcactgcttcctttcgcaagacttttccttagtatgcggcgcacaaacgtgtattataccggtaaaataccattttgatttttgttttcttctgttcacaaactttccagtagtggttcgactttttctgttgtgaatatggtttgttattgcgaaaaatgtttcgttgcccggatgatagtttaactgtccggaaattggggcggctgggcgtgaaattggtttgactgttcagaaatgtttcgcatgatcttgaaatgatcggactgctagtcaaaaacgaaatttcgccggcagacaaaacagagggtgcatgcgagtgccggatttccggcacgcatgtgcaccctctgttttatcgtatgaccattggttgtgttatcactgacctctgtgatcgttgaccgtactgttattgtcatcgatcgcgctgtattttatcacattatggatgatgtttcagctgtcttaaaaatatgctcttctagaaatctacctctgtatcgtagtagcaacacttcaacagtttttccatctcctcctggctcggctgacgcggattcgatcccgtgcaggcatccagaattgcatttgctgcaatctccggcagtctctccaagaatacttcctccggcacgaatccctgctcggtcggatagctgtccgcgccgtaattcttgatacagtgcggaatcttaagatcatcattcatgccgcgcagatatgtaatgaggagcgccactttctcatccagcgtatctccgcccagtcccataaaatctgtgatctcgccgtagcgctttttcgcagtctcatccttggcgttgaatgcgatgaccttcggcagatacatggcgtttgctgcaccatgaatgatatgtgcgccgtaatctgcaaatgcagcacccgtcttgtgagccatcgaatgaacgattccaagcagtgcattggaaaatgccataccggccagacactgtgcattgtgcatggaatcacgtttttccatatctccgttataagagcccacaagatctctctggatcatcttgatcgcatgcagggcaagcggatcggtaaaatcacagttcgccgtggaaacatacgcctcgatggcatgcgtcatcgcatccataccggtatgtgccaccagcttctgcggcattgtctctgcaagctcaggatccacgatcgccacatctggcgtaatctcaaaatctgcaatcggatatttgattcctttttcataatccgtaatgatggaaaatgccgtcacttccgtcgccgttccggatgtggaagagatcgcgcagaaatgtgcttttttgcggagcttcggaattccgaataccttgcacatatcttcaaacgtaatgtccggatattcatacttgatccacattgcctttgccgcatcaatcggagagccgccgcccatcgccacgatccagtccggcttaaattcttccattgccttggcacctttcatcactgtctccaccgatggatcaggctcaattccctcaaacagacagacttccattcctgcttcttccagatactgctttgcgcgatccagaaatccaaaacgcttcatggaacctccgccgacacagatcatcgcgcgctttccctcaaagtcctttaaagcctccagcgctccctttccgtgatacagatcgcgcggtaacgtaaaccttgccatatgctcctccaatccgccacttcctgtggcaaccattttttgcagcctttgcccgccgttactatcataccccaaatccggcgtcgtttctgcatacgttaagtataacatatgcacaaccggcgttgcaattctttccgtttccattctgcaggttttctgcaagagattttcgcatcgtgttctgatatgccgttcccatgttccggcgtggcaggttggggtggattccaggggcttcacatctaaagcagatgactcggttttttagttttttaggttttttagggtttttaggattcttaccgcccgggcttggcggcattctttctaccggtcactttccgcttcataccacgcaacatttctttgtcttccgcacttacacgatatgactccagcattttctgaattgccttattataggtataatcatccagttcattttccagcagaaatgcctgggtctcctgcggaaattttgcataagcagtcgcaattccccatgcgactcccattttgcaataatagccctcatgctttaggctgttatatacggcaagcacacggtcgatatattcaggcaccagaaaatgatccatcagcatcactgccaccacccgctgctcaaattcactctcagacgcgcggtattgcatcaggaaatcccacacctctgcccggtgctttcggacaatcttaaatgtagaacaaaacccatcattgactgaccagtcgtggattttcggaataaatgctgcggcatattccaaaagctcctccatctccgctttcacgtagccaatcacaagtccctgcagcataatctcctcgtaggtgtcatcacgtgcctccttgagataagttctccagtcttcctttgcgagctgcttcgccagcgagcgcagcaccggaagccgcactcccagaatcgaatctgtccccggaatcaggctgctggcaaaatctttgaactgcttttccgcatgtttctctaaaaaatcacgtatctgttcgtttgtcattctttcctctctttgcactgtcaatgaattactgtaaatgcgattctgtgtctgcactgttttctgcgcacaatatgaatctgtcaagattcattatatcatctttttgcgctgctttctgcgcatccgaagttccgcaggaacttctaatatgaatccgataggattcattatatcatctttttgcgctgctttctgcgcatccaaagttccgcaggaacttctaatatgaatccgataagattcattatatcatctttttgcgctgctttctgcgcatccgaagttccgcaggaacttctaatatgaatccgataggattcattatatcatacatcaacgataccccggcaaaaggaattatcgcaataagcctagacctcttctgggtgatgtgtaatattattacaaacacacttggggatttctaataatattacttatcaaagcagggcgcaatatgcttattgcggcaattccatgcaagcgcgttcgcatggaacatatccgtccgctgcacgtaagcatgcgcatccgtctttgcttcatgctcacttttgtctccgcgaacattatgttactaaccgtggattctggtctatgcacgcaaaaacgtgctctcagacccgcaaaatgacagaatagttgacataacaacagtataaaagagtagaacgggtctcagacgcaaaaaagcagctctcagacccgcgaaatagtcaagaacgggtctcagacgcaaaaaagcagctctcagacccgcgaaatagtcaagaacgggtctcagatggcaaaatgtatctcccagacccgccacgacccaaaatgcagtttttataacctcattttctgctgcatcctcccaaaatcagttttttataacctcattttcctactgcaaccgctctggaatcagttttcatagatctcgccgtccacaattcttaccacacgacccgcatgttttgccacattcagatcatgggtaatcatcacaatggtatttcccatctgattcagattttcaaaaagcttcaatacctcttttccgctgttcacatcgagcgcgcctgtcggttcatctgcaagcagaatggcaggttttccgaccagtgcacgcgcaatggctacacgctgctgctgtccgccggaaagttcattgggcttatgtccgatacgctgtgaaagcccgagcatgtcaatcgtgtccatactcgcctcctgagcctccgcgagccccattccacgcatcagaagcggcataacaatattctgcagcacgttgtaggtcggaatcagatgatatttctgaaaaatgaagcctattttctgattacggatttttaccagttccttttctttcgcctgttcgattgccacgccatccagcagatagtttccgctgtccatcacatccatgcacccgatgatattcatgagcgtactttttccggaaccggaaggacccaaaatggcaagatattctccctgctttacggtcagcgacacatctttgagcacatggagggactgcgttcccatgcggtatgatttgttgatatttctcattgtgattacgtctgtattttctatactttctgcttttgtgaccgcgcagatcgccggctccatatccatcactgcatccatatctctataataacctcctcaccgtcttcgctggtctctatcagaagcttcagcagatcgccagccgccagccgctgaaacgtcgtctcggtacctgccgtggtgtgcaccaccgtgctgaccggaatcaatgttgtcacacttttaccactcatgccgccatttccgcccggtgctcctccaccgttacttcctgttccgtccgatgttgcatcgcccggcatgtcgccattttcttcctgcggctgtccgtctgacgtctctgtgttagcatccgttccggaagttccctgcgacatcctgccaggcgcccccgagccatctccagacgcctccgtgctatcccctggcgctcctgcggtatcacttcctcccggcgcccctgaaccatcacttcctcctggcgctcctgagccatctccgcctttttctgtattctcggtgtcttccgtgctgcttgcaagatatgcctccaccaccgattcatcgacttccatatatgtcaattcatttccctcgatgctggtcacataggcatacacatatttctgattatccgccagtgtctccgtgtctgccgtcctgcgggtccatgcgaaaatgcctccgccgccgagcactgctgcaagcgccacaatgccgcccgccaccgctttcttctttatcatgccaaacctcttttcaattatttattccgcgccaagtgcctccactggaaccagattggacgccttataagccggataaaatccgaagatcgttcctgttcccaccgcaaacataagcgcaatcaaaaatgctaacgccgacagttccacacggacgccgaggtactgtacaatcggcgccacagccagcgatgccagattccccagcataccaccgatgagactgattgccgccgcctccgcgaggaactccagcagaatgtcccgcttggaacagccgatcgcttttaagataccgatctcattggtccgctcttttacagatacaaacaatacgttcataatgccgattccaccgaccacgaagacgatcgccgccatcgcaatgagaagcatcgtcagaatctggttggaagcctccgccgcctccatcttgcttcctgcatcctcaaatgtgaactcagcgttcgggtaactggtggcaagcacttctgtcacttcctcgatcacgcctcctacattattcacatctgccgccagcaccgtgatcgtcgggctgaccgatgatccgaccagatatttcacaccggtcgcataagggataaaaatggaatcatccgggctgataccggacgcgaccgttcccatgctttccagcacaccgtttaccacataaagccggtcgtcgatatagatcacgcttccgtatgcctcaatggcactgccgaaaatctcttcggcaacgcttgcgccgagcacgcagactttttctttgttctcatcatcatcgtcggtgataaagcttccgaccgcgagggagaggttgctgatcgtctcgtagttacttttcactcctgcgatggtataggtatcggcttcatcgagatctccgccatccacactggattttgtggtgtaggaaatggtcgctgccgagatgccggacgcaaatgtttcgatgtcatccacatcatcctcgctcagcgtgatattttcctgattcatgcggtcttccatatcgctctgtccgccgaaaaaacttcccatatccggcataccgccgccgtcaccggaaggcatctctccccccggtgatccgcccggcgcctcgcctcccgatgaggaaccgcctcccatatcgccggagggtgctccgccaaaacctccgccaaagcctccgccgccacccggcgccatcattgccatgtcggaatccgaatcatcgctgcttcctccgccgccaaaatctgtcccgccgtcataggaaatgtccaccgcaccggcatttaagtttttaaactggtctgccacgtccgcctgaccgcctttaccaatggcaatgaccatcacgatggtggccgcaccaacgataatgccgatcgaggtcatgatcaccttaaatttgttctgtgtgatattgatccagaccagtctcaataattcttttggcttcattctgtcacctgactttctatcagcacagtttcaccttccgtgagcccggacgtgatttccacgttgaccccgtcagaaaatcccgtctccacatccaccatgcggatcgttccgtccgcatccttcaccttgacataggatgtcgttccgtccgactggaccgccttgttggatacatatagcacatccgtcacctgcctgctgataaatgtgacgtttcctgtcatgtccgtgtatattccagtgatgtccccggtaaacgcggcagtcacattgtaagacaccgtggaggaaccgctggaagatgaagtgtcaatgctctccacctcccccgcaaacgtctgatcctcataggcagacagctcgatctccacgacatctccgactgcaatattcgtgatgtcctcctccgacacggagacggtgatcgtcaccgcatccgtattggaaaaagtggcaaccgttgcgccggaagagatggtatccccttcctcgtactccagatcggtaatggttcccgtatactccgcatagatcgtaccgtcatccccgatggctgtctcaaattcctcaagtgcctcctccgcgtcggacagcgtatcttttgcatcggtaatgtcattgtccgccccggagacatccacactgtactgactggatgcattttttgccgagagttctgcttctttcaacgttttctccgcctcaatggacttcgtggtatagttgtttttcgctgccacaagctttgtgtacagtttgtcataattttcctgctcctcggtaagcgatgcgcttaagtccacgcccgcatcgatctgctcctgatagtaattgatcagggacgccgacgtatccaccgcttcctgcgcgtcatccacagcctcctgcagctgcttgatggcagcttcgtaggtctcctgtgcaacagatccctccgccgtgctcagattgtaggagtaacttgccgatactttttgcttttctgcacttaagcccgcctcgctgacggctgtcttcgcctccgtcaccgcttcctcaagatcttttttataagatgccacgctctcctctgtaagctttaagatgggatcgccctccgcaaccgactgccctgcggtaacatagaccgtttccacctcaagggtcgatgccgtgctggtggacgaagtcgcatttcctcccgcactgttctgcgcggacgagttgttctgcgtgcttgcagaggaagaatcctctgaaaaatcaagagtctgatccagcgtgccgatcgttacactgccgctctccgtcacgcccgccgtcagatttcctttctccacggttacttccttatatacggtctgctcttcactgtcacttcccgactgatttgcaaaggtgacggttcctgcggcaagcactgccgccgcagccactccggtcaccagccaaagctttttcttcttcattctgtctttcctcctgcttcctctgtctcagacgctccgatcgtctcggtttttcctgcggtcttagtctcttccatttctgtggctccagtcgcctgtgtttcaaacttcaccgttgcctgtacgccagtagtaagtgtgccatctgtattgtccacggcaacaatgaccgcatacgtcacattggacatgcttccgccggatgttttttccgatgcgatggaatagacggttccgtcgattgctcccattctgcttccactgatctgtacctgcacggtgtcgccgaccgcaagttttgcaatattgttctgtgatacctccacagaaatcagaatcgtatccagatcgtaatagcttgcaaatgcggtatttttaatcagggtatcccccgcctcgtaagtcaccgatgcaagcgttccgtcacggtccgcacatacaacgccatcctcgatcgctaagagtgcgctctgctgttccttcagctcatccagcgtatcctgcgcttcgtccacagcactctgcaagttttccagcgaagcttcatactcggtatctgcattttttccctccagaaccgcctcttcatactgctgtaaaagcgccggctgcgccgtcatctcattgcgctctgcctcgtcgcaggcgtcactcagctcctccagctcgtctgtcagctccgcaattttctcatttgcctctgtcaccttcgtgttatattcctcgaccgccttctggaatgtctgattggcaagctgcagtgcactgtttgcgctctccgcctctgtctggctctgcgacagggcgtcggctgcctcctgcacggcggtatagtccgcagccagctgatccgccagcgccgcaagatccgtgtgggacgctccggcttcaatctgtgttttcatgttcgccatatccgctgcatatgcgtcctttgccacctgactgctgctctgtgcatcagaaagctgcgtctgcttttccgtgagcgtcgcctgcgccgtatcgactgccgcctgtttttcattgatcccgacctgtgtgtagtaggtgccgttgtcgatggcatcctgataatcggagatctcctccaccgcctcatcgtacgcttcctgcgcctcgctggtctttaccgacagctcgctgactgccgcatcataagtatcctgcgcggtgtccgctgcaagttttgtggaggaaagctcgctctccgcctccagcacgccgttctcaaaattgatctgcgcagattgcagtgccgtttccgcatctgaaatggcatcctcatagtacgcctttgcatccgccatgctctcatcgtcgatcttgaataaggcgtcgccctccgccacggtgcttcccgcttccacgtagacttcttccaccgtcatggtcaccgcattcacagaaaaatcaggcagctggctctccgttttcacctgtgtggttcctgtcccggaaaagctgccgtcttcctgtccgtctgtctcatctatctgtgtgtcctcctccgtctgatccgctgtgcccgaagctgctatcacatgatagccaactccgcttcccgcaactgcggcagtcagaatcccggcaagtattccgtaaaattttttggaatgttttcccaggagtttgtgtacccacgctattttcattgtttcatcctttcccttccggcatttcatcctctctcatgtttcacggtaaggatagcatcgctttctaaagggtagctgaatgtaatgtgacggttatgtgacggaaccgttaaatatctgtgtttcacggtggacagagcgcacatcctttgacagattaggtaaaaagtattacaatacttccgtttctatagatctgttacattggagattattcatgaagaaaattgctttttttgatatcgacggaacactgacttccgagattgacggttcgattccggaaagtgccgtctatgctatacgggcggcgcgggcaaacgggaatctgatgttcatcaataccgggcgctgttttcagaatgtggaacagcgtttccgtgatgtgggttttgacggctttgtctgcggctgcggcacagatatctactgcgacggtgccgaaatccttcatgtcgcacagacgcacgagaccgtaatgaagctgcttctcgcagccagggagtgggatatcgatatcctgtttgaatccaggaaagaggttgcttttgatctggcaagaccgctccggcacccggatgccagacggcagtatgaggcgtttgaagaacgcggctatgagatgccggagcaccttgagaatcctaattttttctgtgataagtttgtcctatggtttgagcaccccgagcagcttgccggtttccgtaccacaagtgaccgctattttgagtgcattgaccggggcggcaatttccgcgaattcgttccgctcggctactccaaagccaccggtcttaactatgtgcttgattattaccggatagacaaaaaggacgcctatgccttcggcgacagcaacaatgaccttcccatgctcactgctttgacaaacagtgtcgccatgggcaacgcctctcctgccacgctttttgacaaggtgtcctatgtaacggaaaaagccagcgaagacggtatccgccttgcgctggaacatttcggttttatctaaagtctgcggttatcccgcacgagcaccacagccatcacaatggctgtgagaagctcggatgccgggaacgacagccacacgccattgatgccaaatgctgcggcaaaaagcattgagcagccaataatgcagacaaatcccctcatgatcgatgtcacaaacgattccctcgcacgttctgtcgcgcttaaaaatcccgctcccacaatattgattccggcaaacagaaagccgataaagtaaagacgcattcccgtgtgggcatacgctgccagttccgcagaatattcactgttaaacagacccaccagcgaatccgtaaatccgtagacggctccgatgagcactaccgcgatgccaaaagccgtggcaagtccgaggtttcgtattttccggacggatttcacatctcctcttccatagcagtcgctcacgatcggctgcgctccctgcgacactccgttgaagattgccattgccacaagcgcaaagttcgcgatcactccgtaagccgccacaccgatatttcccacaaggccgagaatcaggaaattgaacacggtcgtgatgactccggaagaaatctcccccacaaatgccgggacgccaagctgacacgccccgaataactgggcgatggacggcgcgtgcagccggaaccgcacagtattcttttttccaaggaaatgcgcgctgcagatcagaatgctgatgatcggcgatgccgccgtggcaagcgccgctccctctaaccccatgccaagcggaaacataaaaatatagtcaaacagaatgttggaaaaacttcccgcgagggttcccgccatcgctaaggacggctggttatcgttgcgcacaaatgccatgatgacgtagttcatcatgaaaaacggcgtaaacagcagaaagattctcgtatacccggttccaagcgccacaattcccggatcgccgcccatcagcgcgatgattttatccgggataaaaatgcccgcaagtgtaaacaggattccaatgatccacacaaaacagatggcgttggaaaaatagtcgtgcgcccgctcctcgccctgcgctcttaaaatcgtaaagcgcgtcgcagagccgacaccgatcatcgagccgatggcaaaaatcagattgtagatcggcagcaccagatttaagaccgtgattccgtccgttcccgccgccttcgcaataaaaaaggtatcagcgatgatataacaggagatacctaacattccgaatatattctgtgtgacatacctggcaaattgttttgtgactgacatttacttttccccgcagttctttttcatactcattgtttcttatcttacaaccggagtgaaccgcatgtcaagctgtggaggcggcagaatgcggtgcttcccggcttgatatgagatggtatctttttcggttgttcgctttacttttcttttgtagtatgatttaatagaaaccattataatatctttttgcgttgttttctgcgcatccgaagttccgcaggaacttctaatatgaatccgttaggattcattatatcataaccatttttctctatgttcttccatgaatttgttcattcgattgcagacacttttcacccagagcaccccagcgataccaaattcataatcttttctcattatatgccaacgctccttttccacctgtacttaaaacagcagcgggcatttttagcacataaaagtataccggatcctcttaacacacaccatctatagaacaggagaataccatgacacctttacacacacaaatcctcactgcccgcgaccgcaacgggcaggaacttcgtaccatccagaaccagcttcagaagcttcctcccggaaaactcatctgctcccgcaacggaaccactgtcaaatggtatcaaggcgacggtcactccaagacctatattccgaaagcaaaccgcgctctcgccgaacagctggcgctgaaaaagtatctgcagcaacaggagcaaatactcttgcagaaacaggcagcgatcaccgcatatttaaaatattacccggcggacagcctctcttctgatgatccgcatcttctctctgatcccgcctgtgaagatctgcttcgttcttatttttccaccgccaaaaatattccagccgtctcgaatatttcagatatcccgaatatttcgactaattccgctgtcgaatggtctgccgcttcctacgaacgcaatccgctccatcccgagcagctgcttcacaaaaccgtctccggagagagagttcgttccaaatcggaagccatgattgccatgctgctccacctaaacgccattccttaccgctacgaatgtgcgctctcccttggcggcgtcactctgtttccggatttcaccatacgccatcccggaaccggcgctctctactactgggagcattttggcttgatggatgatcccacctacgccaaaaacgccggctcgaaactttctctctatgccgcaaacggcatcattccatccgttcatctaatcaccacgtacgagaccaaagcatatcccttaagcgccggcatgattgagcatctgatttcctactattttctggattccgcggtctgaatccgtacatccctcttccactgtcacttcctgcttttcgtccagcgcgggtctggaacagcgtttttcctctctcagacccgaaaatcacaatatttcgggtctgggagaacatttttcttcttccagacctgggtggcttcttttttctcttctttttccttcttttcgtccacttctcgggtctggaacagcgtttttcctctctcagacccgaaaatcacaatatttcggatctgtgagaatgtttttcctcttccagacccgcacggaaaaggcactacaccattccccaccattttaatccccaatagatgagtccaagcacccagcttgaaaatattccgtataaaatgaccggcccggcaatcgtaaagatcttgcagccaattccgaaaacctgtccttctttctggaactctatggcgggcgcggccacaccgtttgcaaatccggtaattggcaccagcgcgcccgcgcctccccagtttgcaatcgaagggtacagattcagaccggtgagcagtacagacagcagaatgagcagcatagagcaccagcttccagatgttttctgatccagtccgtaattctcacacacgttcagaataaactgcccgatgcaacagatgatcccgcctgtcacaaacgccttcgccatattccaccagagattatgggtgggagtcacctgcttcacataatcattgtattttttttgtaaacgttctttttccttatccactgcgcgacctccgtcttttttgtcagtatgcgcattttatttatttctattcctccgaccgcttctcccgccattttccctctgtaatgctgtgatgcccaggcttgctatgatgcacaagcttgctatgatgccccgggctttatgcgttctgccagtcatccggcaatgtgaccgtccagagatatttttcagtgcgtccccagtctaaaagttcccgcatctgctcatcatatacatcttcgggacggtagtccgccaccatcccgaacagatacttttccttctcatccgctggtgtcagcgtcggtatcttctccgacagaagcgcgagcagttcctccggcttgatgtcctccgggatctcaactccggaaaggttggcgataattcccgcagcataataaaattcataatttcctgtcagaattgacttctgcatattgcacttgataatcacgctctggcgtgcgatggatggcaccataattttcctccgtaaaaaaacaatctcccatcattgtactactgtgccttaaaatttccaaggaaatagtacagcgatcctgccacttttcctgccgccatcgcaagcatgacccagaagagtccgacctttaagcccatgcgccggaatgtaatcggaaatgtattcaggatctccgcgagcgccaccgcgatgcttcccacaaatatcccggcagaaataccgtacacgcacagaagcgccggtccgaacggaatccggatctgcaaaaaaacagacgccagatttccacagattccgcccagaatcacggcattttcagaatgcagtgtctctgccgcgcggttgcactttccaatcatacgcggaatgacaccgatgacgatcaaaaacgcaaatgttcccgcagagacggcaagtcccgcggcaagcccgcagaagcccaaaaatatatgctcaattaacatcgatgctgtgtccctttctctccgcgttctctatgaacgtagtatctatgtccttctcatatttgcgcatctccacctgcatcggcgtcggatccggcgtgatcttcttactgcccacatgattgaaaaacagcgtaatgccaatggcaagtccgatgctgtaacagatttcaagttctgtcacgccgcttgactcctttcccatcacctgccgatagaatttggaaaagacatctcccacggatacatcgttgttgaacgccataatcgtgaacgccgccccgaaaaaaatgaccacgcagagcgcgacggtctttaacgcattgatccacttcggtttctcgggattgggaatgtattcaatgataaaatccttctctccctcattgctgatgtccacattcggatattcctcatgaatcagttcgacgatctttaatatggaaaaaaccttcatctggttcttctgtttgcgcggattcatcacctccgcaaacgtatagatttttttctgcttcagctggcgcacaatcgaagcatccgggcactccattttcgcaatgtccccaagcgtcacatgccggtctgtcacgattgtattctggtcaatcttaagatacagtgtctcactctttgcactcatgccgcagttcccgcttcccatgtagaattccgttccaccagcacgccgtccaccggggtctccccctctctcccgtatttcagatataaaagtgccccgcagatcagcgcgatggccagcactcccacaaggcatgctctgtattttctgcaattcatattcctgtcctcctgtccgtttttacatcacttgcatgatttatgcattattatgcctgtcctcacagatattatgtacaggacaactgacaaaagtaccagattgctttttttataaaaacgtgttactttttcatatggacattttattatcagaaaggcggacatccaaatggctgtaaccaaggaaattctggctctcgccgtggaaatcggcgatgcactgcttcggaatggtgccgaagtctaccgcgtcgaggacacggtcatgcatattcttgaggcatacgaaattgaaaattatgatgtttatgtgctttccaacggaatctttgcaagtgcaaacgaggatcgtgaagatgcctgcagcatgatccgccacattccgctcggcaccacgcatctcgggcgcatcgctgcattaaaccagctttcccgcgagatctgttcccacgaatgttcgctgatcgacgcctggaaccgtctggaaagatgtaaaaatatttcgttcggtaaacctgtcgtccacatcttcttctgcggactaggttgtggctgtttttcctaccttttcggaggtacagccctggacagcatcgtcggcttttttatcggcatgctgctgcaggtatttctgtttgccttaaagcgccataagaattccaagtttatcacgaatatcctgggaagtgcattcgtaacgctgctgtcgctgattgtactctcctttggtacccccatcctctacgataaggtcatcatcggagacatcatgccgctcgtccccggaatcgcgctcactacgtcgatccgcgacttttttaacggagattatctgtccggtgccattcacatgattgacgccatcctgaccgcattttgtatcgctgtcggcgtcggcaccgtcattacgatctatcattttgcaaggggaggtgcagcgctgttatgattatccagtttattgtgagtttgtttgccacactctcttttgcggaactgtttggcgcgccgaaaaaggaactgtttttctgcggtctgaccggtgccatcggctgggtcgtctatgtgatcggcttaaacagcaatatgggcacggtgcttgcgaatctgaccgccaccttcgcactcaccgtattttcgcgtattctgtccgcgatccgcagaaatccggtaaccgtttacctcatcgccggtatttttccgctggttcccggagcaggtatttactatacgtcctactatttcatcatgaacgatatgacgcaattctccaactatggcatggaaaccatcaaggtggcaggtgccatcgtgctgggaattgtctttggcttcggtctgccgcagagctggtttaacgcgctgcagcgaatagaaagaaaaaagacggctttgtaaaatccttacttacacagactgatatgctcccttacatctactgctctgcaatcttcgccgccagctcctccaggtactcccagcgctccatcttttcctcgagtgcctgttctgccgcttccttttccgccagaagttccccaagcttcaccgagttcgtggcgttttccgccatgtcggcatccagctgctccacttttgcttccaagttcgcaatgtcatcctcgatcgtctcgtattccctctgttccttataactgaatttcagcttcttctcacgtttccaggtgtttctggaatccgcctgctctgctgcatcctgcccggatgtcccggtcacaccgccggcctcctgtgcgctttccgcctccgagactccgcgtgctgtcattccctgaacttccgccgtttcgcccggctttctgccttcctccgccagtcggttgacataatctgtataaccgccttcatactgccggatctctccgtttccctcgaaagcaaaaatacgccgcaccacgcggtcgaggaaataccggtcatgcgataccacaatcacgattccctcatagctgtccaggtagtcttccagaatcgcaagggtctgcgtatccagatcgttcgtcggctcgtctaaaatcagtacattcggcgcctccatcagcacgcgcagcagatttaatctgcgccgctcaccgccggaaagctttccgatcggactgtactgctgcgctgccgggaacaaaaaacgctcaagcatgttcgatgccgagaccagaccgtcggtcgtccgcacatactccgccgtgttccggatataatcaatcactttttcctccgggtccatgtaggcaattcccgcttcgcggctcgtctcaatctcctgcgtatagtagccgatcttgatcgttgccccgactgtgatcgtgcctgcatccggtttgatgcgccccgcaatcatcttcatcagggtcgtcttgccgcttccgtttgcaccgatgaatccgatcctgtcccctttcagaaaaatataggaaaaatcccgcagcagcgtccgcccgtcatatcccttggtgatgtgatccagctcgatcgtggtttttcccattctggaatagacggaactcatctccacctggctgtcgcgctccggcgccttctgattcttcaattcttcatagcgctgcaagcgccccttctgcttggttgtgcgcgcttttgccccccgtctgacccattccagttccttccgcagtacagactgacgcttgcgctcactcgcctcggcgctctcctcccgctccgctttccgctccagatagccggaataattcgtctcatagctgtagattgcccccttgtccacctcgacaatacggttgcatacgctgtccagaaaatagcggtcatgcgtgatcatcaccagcgcaccgcgccattttttcagataattttccagccagtccgccattgccgaatccagatggttcgtcggctcgtctaaaatcagcacatcacacggcactaaaagtgctgccacaagtgccagacgttttctctgtccaccggaaagttctccggttttctgtgtaaaatcggtaatgccgaggcgcgtcatcatgctttttgcatcgctctcaaggctccatttctgttcctgtgcatgcgcgtctgcatcggtgcgctctgtcctcccgctgccgacaaaatttaagacacactgtgtcagcacactgtcaagtaccgtcatctccggatcgaacaccggattctgcggcaggtatcttaccacgatatggttggcgcaggtcacctggccttcatccggttcctccagccccgcaatgatttttaacagggtggactttcccgtcccgttgataccgattaccccgactttttctccctcctgcagataaaaggaagctttgtccaaaagcttcctctctgtgtatgatttcgttaaattctccgcgttaataatattcatgtctcttctctttctttcctgtttctgtatgactcaaatggctctcaccggccggcttccttctgcgtttctcctgaaacagccgcctgctacctatcgttttgcgctttctcctgaaacgtgcggatataccgcaggcactcctgttccggcagaggtctgccataatagtatccctgaatacattccaccccaagctgttccatcgcttcgctctgctcccgctcttcaattccctcgataatcagcggaatccccagctgtttgatggtatgaatctcattttcaagcacgatgcgcgccgccttgtcgtggaacgacgcccacacgatttccttgtcaatcttgatctcctggaatggaaaatggatcagataggaacagttcgcatttccgcttccgtaatcgtcgagcgcaaacgacactcccatttttcccagctcatgcatatgccacagcatccgctccggggcgccaatcgccgtgcgctccgtcacctccagcgtcagcatggacggcggaatatggtaactctcaagcaccggccggatggtctcggtcagattctggcgcagacactgcaccatcgaaatgttcacatggatggtgcggattccaagcgagccgttcgagagcacatgttttgagagaaaacggcaacactgctctagcacctgttccccgatatggatgatattgccgtcgcgctccgcaagcggaatgaattcctctggcgggatgaagcccagctccggatccttaagccgcaccagcgcttctaaggacacaatctgtcgttctttcagggaatataccggctgatagtagaccagaaatcccttctcccggatcgcccgcgccacggcaatctccacttttctgcggcggcggtactgtgcgatcatgtccgcgtccgcctccacgatgacctgcgcgccggactttccggcattttcaagcaggaactcccgcattccgtaatattccgccatcgccttaaagtccatcgggtagtgctgcaccaccgtctccatatccagcgcaatgcggttctcctgcaccacccagtcactttcaaaccgcttttgtatctcacattttaacctttcacactgctctttggtgtctgcaaacaccgtaaatgcatctcctgccgtgtgaaacacatgaaattttccacacagatcatacagatactccccgatctcgcgcagcagttcattgctgttctcggtacccagaatcgtgtggatatggtaaaacttgctcaaatgaatcgtgagcacatagccctcgccctttctgcggagccggtcctcaagctgcgattcaaatgccgtcccgtttccgattcccgtcgtcgtatccagaaacaccaccggattctgaatctgcagatagagcattatgagcacgaccgtattgctgacgctggtgcaaaggatctctctgtaccggtattgcagcccgatcatggcggctgccacagccgtgtaggcgcacacgatgaccttcgtgcgaagcgtggtatatttatgctgccgcacgacaatcagaagatccagcaaaaagaagatcacaatatacgcgtatccgtaatccgcgccgacgccctgataataactgccgtcactaaagtagtaaaaaaatccggtcaccggcgtcactgccaccagcacaagaaatgcggcaaacgggattatgcccgcagccgcaaataccgttctctccctgccgcggatcgcacatgccgccataaaataccggtaaaccagatatgacgaagccccctccagcacaaaaaaagcaaacgccagtacctcgttcagacgctgcggaacgagggctgcatttgctaatcccacacatgataaaatgttcatcagacactctgcttcacacacaaacagaagccagccgaatacccgtgtcttctccccgggaaactggcgcacgaatacaaagtgcagtaatataattgtcataattaagagtgatgcgatctcaaaatcataattatactgcacctgtatctccctcctgctcttcctgtgccgcctttgcctccagaattgcctcattgagctggagcatctttgcgtccagcatggacacgattcccgaacactcgcgcagatccctgctgatgtaatccggcgcatttccctcaaacttatagtagatcttgtgctcgaggctcgcccagaaatccatcgccatcgtccggatctgaatctccaccttcgtgtcgataatacagtccgacaaaaagatcggtaccgtcaccagcatgtgatagcttttatatccgctctccttgggatgtctgatatagtccttcacggagattaccgtgagatcattctgcttgccgatcatctcggcaaggcggtaaatatccgacgtaaaagaacagacaatccggattcccgcaatgtcattgatgtaattcaccatattgtcgatcgaggagtcatagccataccgcttcagctttttgacaatgctctccggcgctttgatgcgcgacttgatatattcaatcggattgtactgatgtacctgttgaaattcgtcatttaaaatctcgaccttcgttctcacttccttgagtgccgagttatacagaaaaataatggtgttccagctatctacgccttcacccagggttacttcccctaacgcaaccggcttgtccatgtgttcccctccagatgtctccccttatcatttattgcaatacgctccggcaaaagtccggaaaacctccggcttcccggactcgcgggcgcgtatttcgcagtacacgtccaagaaatcacagatttcttggactaccgggcagtcgccctatcaaaatcgtgccagcgaaaatgtgctctgcaagcaggcaatttttgctgttacgattttggcactgctcattgcttatgtacattataccatattccggggggattaggcaaatcgaaacacagcctgctgaaaccggttctttatttccttccataacttatgcagcttaatcctcctcgataacctgcatttccagaaaatcaaaatcaatctgctcgataaaggaatcctgcgtaaagcgcgtcttggcatggcacttgaattcattcacattcgcctccagccagatcggttttccgagatcaaattcatagcacacttcctcaagcgcatggaaaaccttgtgtgttcttgtctcatcggattcatccgtgatcgtcgtatcccgcagcaagtggttgttcttcatcatcttaaaccagattctcattttccgttccttctcctctgcctgttggtctcatacataagcaatgctgcggatactgccgcattcagggattccacacttccctccatcggtatccgcacgtaggtatctgccagccccgcgatctcatcggacaatccgttcccctcgttcccaatcagaaacgccgtccctttgcagtaggacggttcgtcatagtgcatctgtcccttcagatgcgccgcgtatatgccaaccttctgccgttttaattcaccgatcgtctctgccagatcgtccgcaatatagtagggtacccggtaaatgcttcccatcgtagagcggatggtctttggattaaacagatccaccgtcgtccggttcataatgatgccggtaattcccgcaccctcgccggtccgcagcatggttcccagattccccggatcctggatgctctcaacaatcagcagatgtgtcctgtccccgcgcaacagatcagaaagcggatactgcggcatacgcaccagacataagatcccctgcggcgtctgtgtgtcggaaatgctcttaaataccgcatctgcaacgacttcatagatctttccggcaagcagctgctccgcctccggttcctccagaaagcgctcggagacataaaccttagagagccactccggcggaacctcctcaaacatctttctgccttccacaacaaacaggttctggcttttgcgctcttttgcctttttcatcaatgccgtaatatttttcatctgctgattgctgctgctcgtaatcatgactgctcctttttgttccctaagcggaaaaaactccatgagttcccgcccatggagtcttatgatcgttccaaatactgttatgtatcttacattgaaagattcttgctgatctgatactgatactccggaatgcatttctgcattgcaagtgccgcatcgatgtcgtcatccacgaaatcgccgtgacgataaccaacgacacggttgctcttgccctcgcagagcagatccactgccagcgcacccatcgtggatgcatagacacgatccttacaggtcgggcttcctccacgctgcatgtgacccagaatcgtcgcacgcgtctcaacgccggttgcagcctcgatacgcttcgccatacttgcagaatgtccgataccctcagcattgacaataatgtgatgctgtttgccgcgtttacggttctcgatgatatggtttacaatcttctgctcatcgtaatcatacttctccggaagcagaatatcctctgcgccgttcgcaataccgcaccataatgcaatataacctgcaccgcgacccataacctcgatgatgctgcagcgctcatgagaagtagaggtatcacgtaccttgtcgatcgcttccattgcggtgttcaccgctgtatcaaaaccgatggtatactctgtacatgcaatatcaaggtcaatcgttcccggaagaccgatcgtgttgataccgagtgccgccagcttctgcgcacctctgaaagatccgtcaccgccgataacgataattccgtcgattccatgcttcttgcagatctctgctgctctctgctgaccttccggtgtcttgaactccatgcagcgtgctgtctgtaaaatagtaccaccgcgctggatgatatcggaaacgtcttttgcttccatatccacaatctcttcctgaagaagtcctgcataacctctcttgattcccttgactttcttacccttggcaatggcttccctaaccactgcacggattgctgcgttcatacccggggcatcgccgccgctcgtgagtacaccaatggtgtttatctctttcgccatttatcgttccctcctcatataatatacccatttaatctaccttattttaatctctttatggcttcttttcaatgctctttttgacaacttttacgttattttcccccaaaaacttagttaaattgttcacaatctccggttcgatgcagatactgtagttttcgggcagccgcttcatcgccttgaccgatgaaatatagatcaccaccgtgtctttcccatccgaatcatggagcatggcatagagttctttttccttttccgcaaacgcttccttggtctcaaactgaagccataattcatcgccgcgccgcgcgggaacctgcgcggctgcaccgccacggcttgatccgccgtctcccgcggatgccggactgctgcccgcattcccgcctgcaccgcgccggtatcctccgccctgccggtaagtgcgctgttcctgtggcattccgttctctgcctgttcaaacgtacagatctgctcgcagacgatcttggcgtttttatcctcctccacgttggcatgtccgcggataaataccttctcatcctcattcagcagcgtatgatagcgctcatactcgccagggaatacgattacctccaccgtgccgaacagatcctcgagcgtgagaaatgccatcgtcttattattcttcgtatatttgatggtcttctccgtaatcattccgccgatgataaccttctggttatcccgtagcttgacctcgccgctctcctcgtccagcaggaaatccgacgtcactgccgatatgattctgcgccatttttcctcgtattcctccagcggatggccggtcagatagataccgatgacttccttttcaaagccaagcttgatctccttgctgtactctccaacgttgggatactgaatctcataggcttttttctcctcctccgacaccagatcaaacaggctcatctgtcccgccagcgacttctttttcgtctgcacctgctgatccatcagagcgttgtacaccatcatcatctgctgtctgttaccgtctaaggtatcgcaggcaccggatttgatgagattttcgacggtgcgcttgtttacctcagagtccgccacccgctcaataaaattctgcagggtacggtagggaccgttctgattccgctccgctatgatcgcatccaccaccgaacgcccgatactcttgatcgcatacagtccgtagcggatgccgtctttcgtcgccgaaaaacgtccctcgccctcattgatatccggggccagcactttgatgcccatctgtctgcaggtatagatatactccgccaccttccgcgggttatcaatcacggaggtcatcagcgccgccataaattccaccggataataatatttcagatacgccgtctgatatgcgaccaccgcgtatgccgccgcatgggatttgttgaatgcgtacttcgcaaaatccaccatggaatcgtagatctcattcgccgccttctcactgataccgtttacaatacagcctttgatcccctgctcctcatttccgtaaacgaaattgtggcgctccgcatcaatgacatactgctttttcttactcatcgcacggcggatgttatccgcctgtcccatggaatagccggcaagattctgcacgatctgcatgacctgctcctggtagacaatacagccatatgtcggctccaggatcggttccagttccttgcaggtgtatgtgatgctctccggctcgttttttcccttaatgtactttggaatgaaatccatcggtcccggacggtacagagagattccggcgataacatcctccagactctgcggttttaactccttcatgaagttcttcatcccggcactttcaagctggaagacgccctcgcattttccggttccaatcgcatccagcaccttcttgtcgccataatcaatctggatcgcatccggatcgctgttgtcattataatcgatgtgatcgacgtcgatccgcacaccgtgattcttctccacaagggcaacggcatctttgattacggtaagcgtccgaagtccgaggaagtccatttttaacagaccgagttcctcgatcgttgtcatgacgaactgcgtggtaatcgtgccgtctgaagctctggaaagcggtacatactcatccatcgccttctgtgaaatcacgacacccgccgcatgcatggacgtatggcgcggcagtccttccagacgttttgccatatcgatgagtgtatgcaccgtgtcatccgtctcgtacatggtgcgcagctccggattcatggtaagcgccttatcgatggtgatgttcagttcgtttggaatgttcttcgcaatcgtatcacagaaattgtacggcagatccatcacacgccccacatcgcggatgactccgcgcgcagccagcgtaccgaatgtgacgatctgcgtcacgcagtccttgccgtatttcccgattacatagtcaatgacctcacttcgtctctcatagcagaaatcaatatcaatatccggcatcgtgacacgctccggatttaaaaaacgctcaaacagaagattataccggatcggatcaatattggtgataccggtcgtgtaggagacaagacttcccgccgcgcttccacgccccggtccgaccgggatgccatgcgttctggcataattgataaaatcccacacgatcaggaagtaatcgacatatcccatcttctgaataacggaaagctcataatcaagctgcggcagcagctcgtcatggcggtccggataacgctggatcagtccctcatgacacaatttgttcagatacgtccaggaatcatacccgtccggcactgtaaagtgcggcagcttcgtcacgccgaattcaatctccacatgacaccggtctgcaatcttctgggtattctcgattgcctgcgcggcatagggaaaaagtgcgcgcatctcctcctcggatttgacataatactgtccgccctcatagcgcatccggttctcatcggacaactttttccctgtctgcaggcacagcaggatatcatgtgcctcccagtcctccgcataggtatagtgcacgtcgttggtggcgacaagttcaataccaagttcctggctaagccgcatcagaccggcattcactgtcttctgatccggaattccgtgatcctgcagttccaggaaataattgcccttaccgaagcatgcctcatagcgctgcgccgtcttcttcgcctcatcataaagacctctgacaagataacgctgcacctcacctgccagacaggcactcaacgcaatcagcccctcatgatactgttctaaaagttccatatcgacacgcggtttatagtagtatccctccacaaatcccttcgatacaatcttcatgagattctgatacccctggttattctccgccaacagcactaggtgataatagcgatcctccccatgggacatctcccggtcaaatctggagttcggtgccacgtagacctcgcatcccaaaaccggattgatccctgccttcttcgcttccttataaaaatcaatcacgccgaacatgacaccgtgatccgtgatggctcccgctgtcatgccaagttccttgattcgttttacatattctttgattttattggaaccgtccagcagactgtactctgtatggacgtgtaaatgtgcaaatgacataataaatcctccgttttttcattatattatgaacaacggaattattcaaatcttttcacggatcattcccgtgctttcccatatcagaaatagatagacacgtcccgaaattgtttggttgataatagcggcagacccgccgcttaagaatgagacagactcgtctctacattccagacaggaactcttccacagttgttgagcgcgcagcaagtttcagccacttttccagtgtctcatcatcctgttctcctgcgatgcgctgctgctcttctgccggaatagttccaagttcggctgctaatgacaatatactctgtgctacttttgacgctgcaagtgactccgcaagcggcttcgcaagcgactccgcaagcggctccgccatcgactccgcaagcgtctccgccatcgactccgcaagcgtctccgccattgactctgccattggcttcgcgagcgtctctgccattgattccgctatcgaaggtgccatcagctttgcccttcgctccgcttcctcacggatatactcttccatcgtcatatagcctgcctccaattttcgatcacgttttagatatttgactctctcatgaatattacggattttttcatccggatgcatacacatcgaaacgcacactcttaaaatcgctgtcaagaaacagtgtgtgctccgcatgcgccttcacgcgtggaatctccttattcaggacaatctccagcagatttctgcagatctcctcgtcctgcagggctgctgcaaacaaatatgcattggtcagattcagtttctgaaaactttctcccatatacaagtacctcctctgtgggaagtgcctgcctgtaaaatattataaatcattcttacgtcaaatgtctattggtcgaaatcacgaatttccagatcaggtttctggatatcgactatctcaggatgcatttctttcttttttgtgttataatgcgttgcacaaatgtaacagaagggatcttgatctacatgggaaaaacaggactgattgtcgagggtggcggtatgaaatgcgcttacagcgccggtattctggacaagtttttagatgattctatcgcattcgactattgtatcggcgtctctgccggagctgccaacaccctctcctaccttgccggccagcgcggcagaaatctgcgcttctatactgtacaccttgacgatccgcgctatctttccgtccgcagcctgcttcggaccgggaatctgttcggtctccagtatatctacggaacgctgaccaactcggacggtgccgacccgattgactacgatgccatcatgaaaaatccggctgaattttatatgccggcaacggatgccctcacaggaaaggcagcctatttttccaagttcgacatcgtgcgcgacgactaccgcaccatcatggcgacctgcgcgcttcctgcgttctgccgcccggtcaatgtgaacggacatttctactacgacggcggtgttgccgattctatcccggtacaccatgccttagaacacggctgcgacaaggttgtcatcatcctgtcaaatccgcgcgatttcgtgaagcagccggaggcacaccggccgatctacaagcgcatgctgcgcagatatcccaagaccatcgaagggatcgaccaccgccatatcaattatcaggcttcgattaatctttccaaccggttagaaaaagagggccgtgccttaatctttgcgccgagccgccatctgccgctaggcactttttccaaaaatgcagccttggaacagcagctttacgacctgggcgtatccgattatgaggcaaaacgcgctgccctgcaggagtttttaaaggcgcagggtcactcataggttttctttaaaaatgcctctgccccctcctgtgttttttccatgaattcccctatatccgtccagcggagcagaagtgtatcttccgtatagccctgcttcttaaaataagtttgggcatactgttgatacgcctcctctgtcagcgggtttccgtccgcatccttacagacaatctgcgcctccccttcatcaccgctgttccccgccacatacagccatgacatggttgccagagtctccaccttaatctcatcctccaaaacagacatggcgtctgtcgcatagagatgctccgctggcgaaaccctcaaatcatcatacacaatataatattcctgcaaagtttctttcgtttctttccgatacacggtaagctcatccgcaatcaaatccggttgggaatccccctctacaaaagacgtcttcagttcctttaacgtgccattctcctccaccctgtaaaacctgctgtacgtatagattccggttcccccacagttcgatacaatcagctccagtctgccatcgtgatcaagatctgctatcgcaaactgatacatctcatctgcgtaatctggatcattcacccactgattccttgtccgcgcaatgacggcaagctgatcgtccgcatcctccacatcggaattttctgtctgctcttccgcctgtgcaatactttgtatcttctctgtctcatctgaggaatttaactgagcttccttcgtctctcgctccgtctctcccatcccgtctgcgtgcggtaaagccgtcccgcacccggcagttatcgcacagataagcattcctgctatcatgatcttcctgtttttcatcgctcctgtcccacttttgaaaaatacatcggtatctatccttttaaaatatgtagtatctgttttattttaatgacttcacaggcatttttcaatctttcgtttcactcaagaacaacgtgtgcgcttgccgcacacttgcgcatcctcgcggagcgtttttgtgtaataggaacgaagttccctattacacaaaaaaaggggcggaggctttctgcctccgtccctcttctctgttcctgttttagatcaaccctcacgctttcactgctgccgtcagttcatttccggagacatcaatcagaatcgtatctccctccctgactttatccgcaagaatcagctttgcggaaagtgtctccacatgcttctgtaagaaccgctttaacggtcttgcaccgtagatcggatcatatccgttttccacgatatactgctttgccgcatcggtcagttccaccgtgatctcacggtctgccagacgtttgttgagatctgcaaccagaaggttgatgatgttaccgatgttgtccttcgtcagcggcttaaacataataatctcatccagacggttcaaaaactccggacggaaatgtccgcgcagttcgtccataactgccgcttcgcactccggattgatatccccgtttgcatcgatgccctcaagcagatgtgctgatccaaggttcgatgtcatgatgatgattgtattcttaaaatcgacggtacgtccctgtgaatctgtgattcgtccatcgtccagtacctgcaacagaacgttgaacacatccggatgtgccttctccacctcatcaaacaataccaccgaatacggctttctgcgcactgcctcggtcagctgtccaccctcatcgtatccgacatatcctggaggcgctccgatcagacgggagacggaatatttctccatatactcactcatatcaagacgcaccatattcgactcatcatcgaagagacttgctgcaagcgcctttgcaagctctgtcttaccaacaccggtcggtcctaagaacaggaatgatccgatcggcttactcgggtctttgatacctgctttggaacggatgattgcttccgtcactttcgtgacgccctcatcctggccgatgacacgtttgtgcagttcctcgtcgagatgcagcgtcttgttacgctcgctctccgtcagctttgccaccggaattcctgtccatctggagatgatccgcgcaatctcttcctcactgacgttttcatgcaccagggaaaggtcgcgtttcttcacggcttcctcctcgatctccaactgcttctgtagctgtggcagcttgccgtactgcaattcggctgccttctccagatcgtacttctgctgtgccatcttgatctcattcttgaccgcttcgatctcctcacgcagcttctgtactttttctaccgactttttctcattctcccactgcgctttcttcgtgttgaattcatcgcgcagctctgccagttctttctgcagatttgccagacgctcctggctcagacggtcggtctcctttttcagcgctgtctcctcaatctccatctgcatgacacggcggttcaactcgtccagttccgtcggcatggaatccagctcggtcttgatcagcgcgcacgcctcatcgaccagatcgatcgctttatctggaagaaaacgatccgaaatataacggttggagagcactgctgccgataccagcgcagaatctgtaatcttaactccatggaaaacctcgtagcgctccttcaatccacgcaaaatggagatggtatcctcgaccgtcggctcatccaccattaccggctggaaacgacgctcgagcgccgcatctttttcaatgtattcgcggtactcatccagggtcgtcgcaccgatacaatgcagttcaccacgcgcaagcatcggctttaacagctgtccggcatccatcgcaccatccgtcttgcccgcacccacgatcgtgtgaagctcatcaatgaacaggataatctgtccctcggaacttttcacctcatcaagcactgcctttaaccgctcctcgaattcaccgcggtattttgcacctgcgattaacgcacccatatccagtgcaaacaatttcttgtcctttaagccctccggcacatcgccttttacaattcgctgggcaagcccctcgacaacagccgtcttgccgacacccggctcaccgatcagcaccgggttgtttttcgtcttacgggacagaatccgcacgacattccggatctcatcatcacgtccgatgaccggatccagcttctggtctctcgcacgggctaccatatcatacccgtacttctccagcgtgtcgtaggttgcttccggattgtccgatgtcacgcgctgattgccgcggactgtcgagagcgcctgcaaaaaccgttctctggtaatgccgtactccttaaagatctccttcaatgccttattcggatacttgatcagcgccaggaacagatgctcgacagaaacatactcgtcccccatctgcttcgcctcatcctcggcatgaatgagcaccttatttaaatcctgtccgacatagacctgaccgccagacaccttgacacgcgctgccagatgccgctcggcgttatccatgaagtgctccttctgaatctccatcttctcaatcagcttcggaatcagtccatcctcctgccgcatgagtgcaaccagaagatgctcctgctcgatctcctgatttccatattcataggcaagcttctcgcaatcgttaatggcttccactgacttttgtgtaaatttctgaatgttcataagcgtacctctctttctcttcctatgatatacaggcggcacatatctatgcgccgcctgctttgttctccctgttacaattatgttatagcaccagttgttagcactgtcaagaggtgagtgctaattttttcagataattttaccgccagcagaagcagggacttcctgcctaatatggtctgctctccaacagctccgagagatccatctcacagtcaaaatatgtctcctccacatactggatcttctccacgctttcccccgcctccaggcggcggatcgtctcctccacaagcggggctgtcagcggattgcattcaaaatcagccgcgatgtccccggtctggattgccttgagggcatcccttaccgcatcaaaggacaggataataatgtccccgtcactgccaatcgtcctgcccgcctcccggatcgcctcgatagcgccaaaggtcatattgtcattctcgctgattacaacatcaatatcctcgtatttttcgagaaattccttcataacctcctgcccctttgcctgcgtgaaatcccccgactggcgctccagcatcacccagttttcattctgctggagaacctctgcgaatccgtctgtccgcccgatctgtgcagaggagcccagcgtcccctggagagatacgatatgaactgtctccccgctccgcccctgcttttccagataattctccagccagtgcccggcgttcctgccctcctccgcgaagtcactgcccacccagcatgtatacaggctgtcgtcctccatctccgccctgcggtcagacagaatcaccgggattccggcttccttcgcctcctccagaacggattcccagcctgtctccacgatcgggtcgagcacgatataatccacctcctgcaggatcagattgcggattgccttcacctggttctcctgcttctgctgtccgtcctcgaagatcagatagtagccgttttcctgcgtgaacacatccttaaaggactgtgtgttggtggttctccagtcggattccgagccgacctgcacatatccgaccacaatatagccgtcctgctgcatcgtctgctccgtatccagctgtcccgcagtctctctctgctccccactcccacagccggctgtaaagagcagctggctggcaagcagcgccgccgcgattcctttttttcccacagtcctcttctgaaatatgttcatattcctcccgccttttctcctgccggctgcacctcctgcccggggtgcttttttaacgcagcacggtattttcccatagaggagccaaaaggctgccgcatgaagtggacagcccctggacagccttgtttttatttgctcttctctttgatctttgcaaagatactctgtaatacgatgaagaagcagagcagcgcagccaccgcaatgttggaccacgagctgagcagcttgccgttcgtcttcaccagtgtggaaatcgttccgttgataagtacaccaaagaaggagccgatgacatttcccacaccgcctgtcaataatgtaccgccgataacggaggaagcaatggcatccatctcaagtccgagtgcctgctgcacatttcccgacatcgtgttcaggcagtagcagatgccaccgatcgagcagaggaatgaggaaagcacatacgccttcagcttcgtcttcttcacgtccagtcccatcatggtcgccgactgctcacttcctccgactgcgtaaaggcttctgccgaacttggtatagcggagcatgaaaaatacggctatcagcacgagcagcgccacgattaccgatacacggataaacggaacctgcaccacgcccttgttgttggtataggagccaaacggaaggctgatcttcgtattggcaagctttacaaaaaatgcattgctgctgatggagatctgttccgtgctgatcacggctgtcatgcctctggcgaagaacattcccgccattgtcacaatgaacggctggatattcagatagccgacacagaagccctgcaccacgccgaacacaatcccgatggcaagcacaagtatgcagagcagaaccgcattcatgttccagcgctccatgccgacggcaagaatcatgcagtccatggcaaccagcgagccaacggaaatatcgatgccgccggtcagcatcacgcaggtcattccacaggtgatgcagagcaggcccgcattattgataaggatgttcaaaaacgtctgcagatgtgtgaagcccttattggaataaatcacacagcccacggcatacatcacaaaaaataacgcgatggtaattatcagaagaaccgtatttccatttaattttttcgctttcattatgcagcacctcctttggcaagctgtctccttacagacatttttttcataaatgccttaaacggaggtgcctggattgccacaataatgataacaatgaccgccttgtacaccggtgcctgctcggtcgagatgccgagcgcatacagggtggtggtgatcgcctggatggtgtacgcaccgataatagagcctgccagccggaactttccgccgccgaggctgttgccgccgagtgcaactgccagaatcgcatccagctcgaagttcagtccgatgttgttggaatccgcagagctgatccgggaggaagcaacaatgccggcaattcctgcacacaatccgcagacaacatagcacaggaaaatgatgcgctcggaattgatgcccgcgatgcgggaagccttcttattgatgccgacgctctggatatataagcccagtgcggtcttgcggagcaccagcgatgtgatcaggatgcacacgatggcaaccacgatcggtgtcggcataaatccgagatagccgccgaagattttaaaggaatcatcccggacgtatacgatcatgttgttgcagagcagaagtccgattgccctcgccgccgaaaacaggatcagcgttgccaccatcggctgcacattcagatacgataccagaaaaccgttaaacgcaccgctggcacatcccatcaggatgccgccaagcacaccgacgatcagcggcgctgcaaggctgttggtggaggacacgccgtagcctgccagaagcatgcagcagaacgatgccgccagtgacatgaccgagccgacggaaatatccgttcctgccgagcaggacacaaccagcgtcatgccgatggcaagaatggcaatctcactgccgcggtttaaaatatcaatgatgcgtccgtacaataccccgttgcggatggagatggtaaaaaagttaaatgcaaaatttcctgccatcacatcatagatgatatttaccgccatcaccagtatcatacagaaaatcggtaaaaacaacggctggctgaccagcttcttaaacttactcattcctgccacctcctgctatggactgcattacatgcccctgggtcagttcctcagtgatctctcccacttcctgaccatcccttaataccaccagcttggagcatgttctgagcatctcctcaatctcggaagagatgaagatcagactctttccctgatccgcaagctcgatcacaagcttctggatctcagtctttgtcccgacatcgatacctctggtcggctcatccagaataaggaattccggatctgtggcaagccagcgtgccagaatcaccttctgctggtttccgccggagagctgcccgatcagggtctccctgctcgccgtcttgatctgcagcagctcgatatacttgtctgcgatctcgttctgtctgctcattggaagcagcttaaacattccgcgctttgcctgcattgccagaattatattttctcgtacagataagtctgcgataatgccctctgcctttctgtcgtccggaagaagtcccattccaagattcatcgcatcaatcggcgcattgatctttgcctcttttccgttgacaaacagcttacctgtctggtttttatccgctccatagatgacacgcgccagctcactgcgtcccgagccaagcagacctgtcagtcccacgacctcacccttatgtatctgtaaatcaaacggcttgatctttcccttgtggctcatgccctgcgcatcgataaccaccggcacattggtgaaatccttcttctcttctgattttacagctgcaaggtcatcaaaatccttgcccatcatcgctgcaaccagctttacccttggcagctcctcaatcggatattctccgaccagtatgccgttccggagcactgtgatccggtcacagactgcgtatacctgctccagaaagtgtgtcacaaacacaatcgccacacccttttccttcagctgccgcataagaacgaacagcttttcaacctcatggtcatccagggaggatgtcggctcgtctaaaatcagtaccttacaatccatatccaccgctcttgcaatcgcaatcatctgctggagcgccagtgaatactcttccagatttttggttacgtcaatatcaagatccaggctcttaataatcctgttggattttgctgtcatcgtcttccagtcgatggttccaagctttgtcttcggctccctgccgataaataaattttctgccacactcaaattcgggcaaagattgacttcctgatacaccgtggatatgccctttttctgtgcatccagggtcgaatgattgaccaccggttcatcgatcccgtcaacgcgtatttctcccgcatcgaacgcgttgattccggtcagacacttgatcagtgtagatttcccggcaccattttctcccatcagtgccatgatctcgcccttccgcagtgtaagatccacattgtccagtgcctttacgcccggaaatgtcatggtaatcccccgcatggtcagtaccacattatgctccattttactccaccctttccttaaaattgggagagaccaacgggcctcccccattacaaattccctgtctgtgaagcagcttcttctctgtccctgctataatgtttgtcctgttgccagaccgtcttaatactgtgcgtcaacgatctcctgtgtaaccacggtaagctcctgctcctcgccgtttaccgtgatggatgaaaggatgtcctcatttacataccagtgctcaaccatgtatacttccttgtcaggtgtgctgccggactctaactgctggataacatcctctacaaacggagctgcaagcgggttgcactcgaagtctgcattgatgtcgccggacattacatactcaagacctgcggtgcaggcatcgaaggaaatcaggatcacgtctccgtccacaccataggagatacctgctgccttcatggcatccatcgcaccaaatgcctcgttatcgttctggcataccactacattgaactgtccctcgtagctcttgatgtaagactccataacctcctgtccaccagcctgtgtgaaatcaccggtctgggaatccagaatgttccagccgtttgcatctgcgatctccttgaagccgtccgtacgtccgatctgtgcggaagcaccggttgttccctcgataacgagcacgttcacgtcgctgatgccctttgcatccgtgtaagcctttaaccactcacctgctgcaagaccctcattcttgaagttggagcctacccatgaaatatatttgtccgaatcatcaatcgtacggtcaatgacgataaccggaatacctgcctcctcgcactctgtcagtaccgtgtcccagcctgtcgatacgatcgggtcgatgatgatgtaatccacatcctgctcgatgaagccacgtactgcctccagctggactgccgaatcctggtcgcagtcaacgaactggagatcatatccgttctctgccgagaagatggactgtgcggaattcgtggatgcggtacgccagtcagactcatggccaacctgtgcaaagccgattttgattacatccccgtcagctgcgtctgccgcatctgctgcgtcagaagcatccgctgcttcgctgtccgctgccgtatctgcgtctgctgcatctgctgccgttgtgttgctgctgtcagcagcctcctcgcttccgcagcctgccagtaaggttgcgcccattgccatgcacatcagtacactcactaacttttttttcattttaaaaacctcccaaagtttttattagatttggttaagtccttaaccatgtacctattatagctttcggacggtttaaaaaataccgactggcttttgaaataagtaaaattttttactaaattatgaacagctcattcacaattttgccgtattttcctcaaaaggtgtaatttttttggaaatgttgcgttttcttttgattttctctgcccggcacggaatccgcacccagatctcggtgccctgcccgtaggtgctctgtatcttcagtccgtactccctgccataattgagctggatacgctggttgacattgaacagtccgaagccgcccgtctcctcctgctccggctcctgctccccgtcgcggagcatggcgcacacctgcgcaagccgcgcaccgtccattccgattccgtcatcctgcaccttgaaaatcatgacatcctggcagagtacaccggacacccggatatgtccgccgccgcgcttgttcttgatgccgtggtagagcgcattctccacaagcggctggagcgtcagcttgatgatctcatattcatagagctcctccggaatcgcaatctcatattccagtatatccctgtagcggaactgctggatctctaagtagctgcggatgtgctgctcctcctcctttaccgtgatgaactcccgccccttgcttaaggttgtccgaaaaaagcttgacagggacgacaccatcctcacgacctgctccgtgtccttcgactccgcgagccagatgatgttgtccagtgtattgtacagaaaatgcgggttgatctgctcctgcagcacgcgcagctccgccgcgcgcagattcagctcctccacgcgtatatcctccacgagatgcccgatctcctccaccatctggttaaagctgctgttcagaaccgagagctcatccagctcctcgtcctgcgcccggatcgcaaaatccccgcttcccgctgcctgcgcagcctcacacagccgctggatgggctccgtgatgccccgcacaatcctcctgctgaccatccatgccccgagcagtatcaggacgagaatcactgtgatcgccgtgatggcactctccacatccgcgcggattcccatccgcagctcctccatgttcgttgtctcatagtagatataatactggatctgctcctgtatcagctccgtcaggacgcggatattcagatccagacgctccatgttcgtctcataaagcccggtcacaagcgcatccttctcgatctcctccacacgatcctccagcgtgtcaagactctttagtatgcttgacagccggttcgcggcgtactcggaatctgcctcctcatagagctcgccgaacacctcccgcgcggcctgtatcatccggtgcggctgctccgtgtccaccagctcctcggcacgctccgaattgactacgataatatacatcacgtagtccatgtcctccttgaaattgatgttgtacgcgtttgcctttgtgattctcctgacaatcccgtcatactcggaggaaatcttgttcgtcataatcagaagatacgccagaagtatggtcagcggcaccacacagatcagcagcagcatatagagcctgctctttagtgaaaaccctctcttcaatatccatctccccttttaccctctgctgcggtactcacccggtgtgcagccctgcgtcttcttgaacaggttgctgaaataatgcgcatcccggtagcccacctcaaaggcaatctccgttaccttctttcccgtcgtcctgagcagctccttcgctttttccatgcggattcttgtaagatattctacgaacgtctctcccatttcctgaccgaataccgtgctgaaatggctcggactcagatttacctccgctgcgaccatattcagggaaatcccgtccttctcaaaatgatcgttgatgtaggtctttgccttctgcatgatgccgtcgtattttccgtccaccgcctcactgcgcaaatccagcaccgccgaaaaaagcttcttaatatattccctggtctgctcaaccgtggtcaggtaggctgccatctccttcgcatcgccgcaccgctccacgagatccctgctcttgtaaccgctcttctccagaacggaaaccgccgtcacatacagatccatcaccacgtactggcgcaggaagatagactttacattgccgtccccgagctgtgcaaagtaatcctccacgaagccggacacctcctccctagtgcccgtgtacagaaaagcctctgcctgccgctgactcaggctggagatattcagctccccgagctttacatcctccagaacctccgccgcagtctcccccggcgtctcctcctcaaggatctggttgcgctctaccgaatagcgtctggaaaagcacaggttggtctgccggtagcactgctgcagctcgctgaaacgctccaccggtgtcccgagcgccgcgacatactccaccgccgtctctctccggaaatactctgccagcaggctttttacctgctctgtcgtctccgcgagagactgctgccctgtgcccttcagcacaaaatcgtactccgcccggccctgctttgcgacaatcagattgccggactgctccatgtacttctccagctcctgctcgaaggcttttatcttctccggcaggacatcctccttctcctcggagaacagctggagcatcatgatattgtactgctccgcaatcagctcaagtcccagttccttcgcctcctggaacaccgacgcataggtatgctttccggagaccatgtgccggaacagccgctgcctgccggcagatctcacctcctccggcgtctgctgcttctgcttcccgcgctcctcctcgatcttctgaccgatcttcttgagtgtcccgatcagctgtgcacccgtgaccggcttcaccagataatccgtgattccgatgtcgattgcctcttttgcatactggaactcgtcatacccgctcaggagtatgatcttggtctccggcagctcgtgcttcacgagacggctcagctccagtccatccatgaacggcatcttaatgtccgtgatcagaatatccggtctcgtcttctggatgatcggataggcgagctccccgtcgcccgcgtcaccgacaaattcaaagccttcaccctgccagtcgatgttgttctttatgccctcccgcataacgatctcatcttccgctaaaaaaacctttaacatatgaaattcccctcaatacattttcctgtaaaaaccattgtaaattcattttatcacacctgcgaacaaaaaacacagaagattttggctgtccgggatgcctatcaccggattctgctcgatgcagtcgataccctcgtgcagaaatgtccccccgcatacgcaggacttccggcgctcagggaacgcatctatttaggtatccagcttctggaaagctttgcgcacacccagctggagacttccctctgcagtcagtttgatatggaatccatgcagacactctgcctccggattgcagtggagctgctgacaccgccgcatcagacgggatccgatacggcagtgtcatgttcacactaatcttatgaaaacgccctgcggtcttaagcttccgtgctccaatccgttcgcgaacaggcagtcctccggctccggcagtccccgctcccctgtccgcaccggttcctccccggcgttaatgcagacctccagcgttttttgtccttcttttttcttataataatgtaacaatctggaatcctctctgacatcccacatcacgttcccgctccttgtctgcggatactgcctgcgcatcgcaatcagccgctttacctgtccggtcagctccgcaaagctacccgcatcgatctcctcccacggcatgcacttccggttcgcctttgttccgcctccgtccatgccgatctcggtgccgtagtagatacccggcgcgccctgcatggtgaacagaatcgcaagctgtgccagaaacgtatccgcattaccgtgacatctctccatcagacgatccgtatcatgggaatctaacagattaaacagcacccggttcacctgctcgtagtacatgctgtaacactggttaatgccatgcataaaatccattccgctctgtaccgcatctgcccagaagttattcacacacgccagaaacggatagttcatcgtcgaatcatactcgtcgccgagcagccacgggaaagaatcgtgccagatctcgccgagcaggaaaagctttggattgcactttttcaattccagacgcagatgttttaaaaatgcatgtgaaatctcattgccgacatcaaaacggattccgtcaaccttccagtcacatacccagtgcttcgcaatgccggtcagatactccatcacatccggctcgctggtatcaaattttggcatattgtcgacaaacgcaaacgaaaaataatccccccgcttcgtcgcatgggtccgctcatcgatcggccagcggttcacgcagaaccagtgataatagtcggactgcggtcccttttccagcacgtcctgccagagcgcgcacttcgctccgcaatgattaaataccgcatcgatcatcacgcgaagtccgagcgcatgcgcctccgtaatcaacgccttcagttcttcctccgtgccgatatccggctccacgctgtggtagtcgatcgtgtcgtaccggtggttggaatccgaccacagaatcggatttaagtaaatacctccgacgccgaggtctgcaatataggcaaggcggctgcggattcccgccagatcacccccgtaaaactccttccatgttgcatcctcctgacaagcccattcccggcaggaatgacgcttttctcctggattttttctgcagaaacgatccgggaaaatctgataccacacgatattctccgcccattccggcaccttcataatgtccgcccggttcatccacggatagataaaacgctggatcatccggtccgctggaaagcgctctgccgctttcacaaatccatcctcatacaggcagacgctctccccgccgccggtgatctcaaaatggtacttgactctgcggtacaccggtgtgaggacggcactatatacatttctgtgcgccagttcccgctccagttccatcggcacccgctcgccctgccagttctgctcgttctcggcaatcccggcggaatacgggtcgcccgcccagaggatcacctcgtccacatcttttcctgtctgaatacttatttttaaatgtctctcatcaagcggatagcagtctaaaaaatacgcccgatgtgtaatttctgccagattcatagttttccccctgtacaaatttgctgcagatctcctgtcagctgctccgggaactccggatttctattctacgcacagtatatctctgcgaggggaatttttctcacactatcaatcgcgtaacctgtacaaaacaatcattttttctttcacttctatcacagcatccggccggaaagcagttcgcttccctcttcgtaatccaggttctcatatgccgcatgcagttctgtcaacagttcccgttcctccgctgtcagatgggcacgcgcaaaccgggaaagtccctgctcaatcccgtttaaatcacacgcatcaaaagcttccctaagctgcgccagaatctgctgcttttcctccggtatgtcctctgccgtggctgcgccttccccctgtatctcctgcggcagattctttaattcatcctcgacactctctaacgtgtgccggatcgtctccaaaaactctgtcatatgcttttccatgtatcggatattttctgtctttgccgccatttccatgatttctgcgctctcgcttaacgcctgtctgccgatctgctggctggcgcccttgattccgtgcactttcgttccgaaaagctccagctgctccggcacatagcccggcagttctgctgcaagcgatcccgtctcctgcaaaaacgtctgcaagagacggcggtatgccccatggttcatctgcgcgtgaagcaggaaatccctgcgctctgcgacaggcagataagtctcaatcactttctttagctctgacacatcgatcggcttgtccagatacgccgtaaattccggtctgcgattccgatgctttaactccgcggtaatatcagcagtcataagtaccattgggatatcgcaaaactggcggatctccttcgccgcttcatcgccatttttttccggcatcctctgatccagaaaaatcagctgatactccttccgcgctgccgcctccacagcctcctttccgttgcgcacaacatccagtgtaaaccgccacggcgctgcgagttcctggaaaatctcctgattgatccgcatatcatccgcgagcagaacatgtgcccccggatagatccatgtcggctggatccgctccgtatagaccactgactcgcgcagcagactgtccgtcgtatagcacaccgcatcatgcagggtgcttccgcacaccttctgccggatttccacggtaatcgtggttcccctggtgccgttgctctcggcgcggacactgcctcccatacggtttgcaagttcctttacaatgctaagtcccagtccgtttcccgactgtccgctctctgccgcatagctcacataagaatcaaatccctgccgcagctgttcgcttgtcattccggtgccggtgtccgacaccctgcagcggaccatcacatccgaggaatcccggattgcctcacaggtaatcacacagcggatctcgccctcctctgtgaacttgaccgcatttgcgagcagattctgcaaaatttcccggacgcgcatggcatccccatacattttctccgggaattctccctgtatacaggcctcaaaccacaccctcttcgactgcagattgatgacacacatgtgtgccacctcctcgagcacctgatccagccggtagcactccgccatcagctcgaactttcctgcctcaattctggaatagtcaagaatcgcattcacctgttccacaaggctgttcccagctcccttgatgtgaagcaggagtgcacggtcacttgccgtgagttccttgcggctgcttaaaatatccgtgattccgatgatggcgtgcagcgggcttttcaggtcatggctcatctgcgcgaggaaatcacttttccgcgccgtctgcatctctgcttttccctttaatgcctgcatcaactgcgtctcttttttcgggctggtaatatcccaggcaccgagaatatatccacgaagcctccctgaatagtacaccggcgtacactgacactgataatactgtccgttcttctcgatctcccggctcttttttccctcctgtatggacttcgccagctcctccgcctcctgcatgtatccgcggtgcctgcggctgtttctctcatacaactgcatcggacccgcaaacagacttctgccgctgcggttcgcatcaacgcaataaaaattggtatccagcagtaccactgccgtatccgagtcatcgtacagccgctcgcgcagaagctcgcccgtatccatcagctgatccgtctggatcagataatgaaccgcaccgcagacaccagttgtagctgccagcatcagaagattgcccggaatagtaaaaaacttttccgcgcacatcgctgctgcattcacgagcagcacaatatagagcagattggcaatctgatgctcatgcatggtcagggaacggcgcagataggcgtaggtccccattgcaacgatcgccgccgtacatccgattaagtaaattctgaaataaatgtgatagatttccggctgccggtagcgcataaaaacaatcacattcagcgcgagcagcacacaaaacataatccactgcaccccgtaggggatatggattttcagaaaatccatgatatagataagaatcagataaagcacctgaattaagagcatgtccttcaaacgcccgaacaattctgtctgtccggtgagcgtaaggacaacctgatagaaattatatacaccgatcagtccgaccagcagcggcagcagcctgtgctgtctggaatatgcaccggaagtggcatattcctgcagtacatacagcgtataacaaagacatattatctgaaccaataatatcattcaatctcactccgccccatcagaatcctcttgatctctgtcttgacaaagaccggcttgtacggtcttacaatgtaacctgccgcgtccagattccggcacagcgtgaccgtctgtctgtcgcagagcgccgtgacgaacaggatcggcaccgtgtgatccgtcatctccataatgcgtttggccgtctcgataccgtccatctccggcatatcgatatccatcagcaccagatccggcgccggatgttttttcaaatacagcaatgcctggtgaccggatttcatcaggatgacatcatataacggctctaaaatgccacgcagcatctgcagattcgtcttcatatcgtccacaaccatgatccggcagcgtaccggcgggcgtatcatctcgttgcgctccttttctgcctcttccgtggagaagccggattccgtcttcatacgcaatgtaatatggtagttcgcttcgttggacagatccaacagttccccgtccatcagacgcactacgggtcttaaattatgtacgccaaaattctcatagatgatggcttctcttccatcggaaagcgtaaccatcgttcccttcggatagagcggcacatactttagaagtgtctccactacctcgcggtcaaacatgatgccgcagccgcccatcagatactctgtcgcctcgtacggtgcgtatggctccttgtacgggcgcctggacgtaagtgcatcatagacatccgccacgtgcagaatcctggtaaacatcgtctgctgcgcgccttccagcccgtccgggtatccgcttccgtccacattttcatggtgatgcagcacggcctccttgatatgcgcagaaatatcccaccgctcactgataatctggtacgacagtgttgcgtgggatttcataatcagatattcttcctgtgtcagacgtcccggcttgtttaagatctcatccgggatctgcagctttccgaggtcatgaagcaatgccgcagtcacaagatgccccagctccacttcactcatccccatacccattccaatgacgccgcagtataccgccacgttcacagaatgtgcgtaagtgtaatcgtcgtagcttcttaagtccgtaagatcaagagacacatttccgcaggataaaatctcctccaccatgcgtctggcaatcaacttacatccgtcaatgtcgcaggcacggatgcgctcctgtccctcctgccttaactgcggcgtaatcacactctcaatcgtgatgccctctgaaagtttatcttctatatatataccgtcgaatccgtaagcttccagtttttccagatagctctccgtcaattcgcaatggcagccaatcaacgttcttccgacggaatcataaaggtcggctgcaagaaccatgcccggttctgcctccctgagtggtacataacgcataacattcctcctacctttcactgtaccaagccgacctcataaagtcaatgaaacttttgaccttattttctaggattcgacagaaaccacctcgtaatcctgatcctcaaccgccttctttaagacctcatccgccacgtcgctgctaagcgtcacaaccgcgtttcctgcctcgtggctgactacagcctcctgcacgccttctaccgcttcgagtgccttcttgactctcgcctcacagtgtccacacatcataccgttaatcttcattgtctttttcattgtctcattctcctttttttgatttgtttctgatttcttctccaaagcgtcatccggctccttcgccgcagctgcggcggtctgccctgtcaccgcatttttgatcctgcggtcttttccgacgtcatacatccggaacagattcaggcgcagcgcgttggtcacaacacagaaactggataagctcatggctgccgcaccgaacatcgggtttaactgccagccgaacagcggaatccacacgcctgccgcaagaggaatgccgataatattgtagaaaaatgcccagaacagattttcatgaatattgcgcagggttgcgcggctcaagcggattgccgcaggcacatccgacaggcggctcttcatcagcacgacatccgcggcatcaatggcaatatccgttccggcgccgatcgccattccgatatccgcccttgtaagcgccggcgcgtcattgattccatcgccgaccatgaccactttgccctttttctgcagttctcttaccacctgctccttgccgtccggaagcacgccggcgatcacctcgtccacgcctgcctcttttccgatcgcctgcgccgtccgctcattgtcgccggtcagcatcaccacatagattcccatgttctgcagttctgccaccgcacgcgggctgtcctccttgatgacatccgccacggcgattacgccgagcagcttctcatcctttgcaaaaaacagcggcgtcttgccctgcatggcgagctgctctgcctgccgcttcatggcatcgggcaccttcacgtgctgctcgataaagatgagattgccgccgtaaagccgtcttccatcccgcacaccggtcagaccattgcccggaagcgccatgaaatcggtcagcatatcttctaggccgtccgctccgccagatgctccgcctgccgcagacgccctcttcccgccggactgcgcctttgccccggcctgctccttcacataggcaagaacggcctttgcaagcggatgctcgctcttctgctccagaatccctgccgcatgcagcagcttctccgccggaacgccttccgccggaaggacatccgtaacccgtggctctccgctcgtgatggttccggtcttatcgagcgctacaatctgcatttttccggtctcctccagagagactgccgtcttgaacataataccgttcttagcacccatgccgtttccgaccatgatggctaccggagtggcaagtccgagcgcacacgggcagctgatgaccagaacagagatcgctctcgccagcgcaaagccgaccggctttccggcagctagccacacaatcagtgtcacgatcgcaattccaatgaccgtcggtacaaatacgcccgataccttatcggcaatcttggcaatcggcgccttggtcgccgcggcatcgctgaccatctggatgatctgggataaggttgtatcctcgccgactcgcgccgcctcgcattttaaaaagccggactggttcacggtcgccgcggagacttcatctcctggcgccttgtccaccggtatgctctcgccggtcagcgccgcctcattcacggcactgctgccctcgaggatgataccgtccacgggtatgttctcccccgggcgcaccacgaagacgtctccctttttgacctgcgcgaccggaacctcctgttccacaccgtcacgcacgatggtggctgtcttcggtgccaggctcatcaggctcttgagcgcatcggtcgtcttgccttttgaccgcgactcgagcatttttccgaccgtgatcagcgtcaaaatcatcgccgccgattcaaagtagaactcgtgcatatagcgcatgaccccgtccatatcgccgcgcacctgcgcatcggtcattgcaaagagtgcgtaggtactgtaaccgaacgccgccgttgcccccagcgctacgagtgtatccatattcggtgccctgtgccagagactcttgaatccgctgataaagaacttctggttgatgaccatgatcaccaccgccagcaaaagctgtaccagccccatcgccacatggtttccttcaaagaacgccggcagcggccatccccacatcatgtgtcccatggaaaaatacatcagcactgccagaaaacctaccgaagccaccagtctcttttttaaaagaggcgtctcccgatcctttaacatatcttcctgcggcatcgcctccgccgctcccgcggtttccgcgccgccccgcttcttctcggcagcgccgtatccggcgttctcaaccgcccggatgatctcctgcggcgccgcggttccctcgacacccatggaattcgtcagaagactcaccgagcaggatgtcacacccggcaccttcgacactgctttttccacgcgcgcgctgcacgccgcacagctcattcccgtcactgtatattgcttcatcttcctcactctcccgtctatttcatcaatttctggagcaccgtcaccagttcgtcgacggtctcctccctgccctcgcggatatcattcgtcacgcaggtcttgatatgattggcgagaagtaccttgttaaagctgttgagcgctgcattcacagctgccacctgtaccagaatatccgtacagtaggcatcccgctccaccattcccttaattccgcgaatctgtccctcgatgcggttcaagcggtgaatcatatccttatattctttctctgaccgttcctttgtcttatgggaacagcagcattccttttcctctgccatacgcttagccctctttcttactatttacccgcaagtctgtttctattcctcatttgcaggctcattatatacccccttggggtatattgcaagtgttttattgtgttatttttctcatcaaaaaaatcccggcctgtccaaccggaccagccaggatcttttgggaatctgccgtcatgcggcagtctcttttatttatccgcaaaccctctccagaatctctgtaagtgcacttccgctgctggtatggcttctcaccacatccgcattgcagcgctccgcctctgccaccgcacaccgtaccatcttatgtgatacggtgttggtgaagagaatgatcagatccggtgatccgatctggttcccgagctttgccggcatctgtgtaaataccttcgctttacagttatgttccttacagatctttttgtactggcagaccatgcggtcatgtccacctacaatcacaacgctcataactacaccgtcgcaagctgcttaccgagatcagtgcaggcagccacagcctcatcgtccggtgcctccttacagatcacgccttcgccgtttaatacattcgcacctgcggatgacatgcggtctacccagtcacgcatccactgcccgtctccccagccataggaaccgaacagaccgatggtcttgcctgccgcaaatccttccacctcggttacgaaaggctccatctcgccctcctcaagaacctcagcccccattgccgggcatccgagtgcaaatgcctttgcattctttaattcatctgtagagacgctgcttacgtccaccactgcggcttccttacctgctgcagtgattccggcaccgactgcctctgccatcgcctgtgtatttcctgactgtgaccagtatactacataaatcttatccaacacttttccctcctgctatatctctgtattctgctatgtaagttagtcttaactaactttagctatactatactaaataagaagggtttcgtcaagtgcagtaaatgaaatatttttctcattagaaaactgctattccacttcatccgcgaacttcgtcaggtagcgctgattctcctcaaattcgcaggtactcgcattgtcaagcaccttgcgcccgtagaaaacgcgcttttcctccacagggatcgacagtgtcgccgtgccgttctccgtctcgtaggagacttcgtcaatccccgtctcaccaagtgcccgatatgcgtcatacagcgtgtgatccctgtatccgttcaccatctcccagtagagagcatacttgtcactggttagccggtacaaatccaatgtatcatataattcatgatatccgcgatctatgtactccctttcacaccagtccagatgataggcatcgccggaatattttccctcatccacagcggtatcaatcaaagcccacaatatcgagaacacgaaaaacagcgcaatcacacatccggctgccttgactgccagcgtcgacatatttacctcgtagtttccagtctcatccgaaaatttccagagtatttttatatttttaatcttcctcataatcccagccctttctctcaaagatccggcgtatcagttcgtccatctcctccgagtcgcgctccatccccatcagatccgccagttcctcctccgtcatttccagagtaccaagcagtgccgctgccacgtcctgtttcatgtcatcatagtattccttgttttcttcatactccagcccgcggtaggaaaaatctgtctccatttcgagaatatccttcccgtccagaagcacatatttcacccagtttggacgcatctgctgcccggtgggccagtctaacacctcctggatgcggaacagatctctcataaatgcctgatcgtcgtcatacagccggacgcgctccgtatatttttcaaattcctcctgcccatacacctcataggaatgcagataatcgtaaagtccggtataatcctctgccgcaagcagttcttccgcctcctgtacagacgcccgattccgctggcaggtaatgtgaatgttctccagaccaactccaatcgcgagcaccagaatcgtaatcgctgtcactgccacaacaaccagcagaattacattcatcactttatccgccacatacagcggcatggaatggatgatctttgctttggcgagcagtgtctcctttctcgccagattttcctcgtttctccacttttctccaagcgggtttggctccccgcagtagggacatttcagttctttcgccggataatcatatccgcattttttacatatcatcttcgcacacgccctcgcttttattccgtaagatgggaaaatgcccgctcctgcatcatccgctccagattgctctgattcgcttcatctgcaggatcatatcctgtcatcacttcccggatctcttcctttgtcagcgcataatgctcctctaaataagtataacaatattcccggtaataagtgaccgcttcctgctcttcgtacttgtaatcagcatcttcgctctcctgacagatgcaaagagcatccgtgatatacttcacatcatccagctcttccgctcttccctcccggataagctgttccagatactgcccgtccggggttatgacgtaattcgcggtatagtcttcgagcttctccaccagccggtatttgcgaaaagcctgatcatatagttcattatgcttttccagatacgtgcagattccactgtagtcctgctgctgatacatcttctccagtttttcctgcattgcctgctccctgctgccggaagcagccgcgtgaatgcgtatgccaataaacgccgcagcactgagcaaaagccctgccacgatcacaacaatcaaaatcttcgcggtcagggacatcccggtcttcgccatccgctgcggcttctcctcccactgccgtttctcgcgtttcagctcattgacggcatcctcatgcatctgtacggaccttccaaaattatcgccaccgcaatatggacaacgcggctcgtcatcttcataagacgcaccgcagttattacatacgatcatcgtttctccctccggtgcctccgcagaaatccgctccctgaggcaccctgtgttattctttgtctattatatcagttttttcctgtataggaagcattttcctatgaaccaaaaaagcggggcagtcgcttgaaacggacagccccttttggagtgagaagtaatagaaaaagaagcacatcctaccgatttctgatggaatacatctggaaattcggttcaaaaaatgtggcatttctaaccagccgaatgtttgcatcttcgatgatccgtgtctttccaagtttggagcactccgcgggtgtgtccgcaacccgcagacaattttaggattccctagtgtcccttgcggcaccagggaatccgctcattgtctgtggcttgtcggacacactccgtggattgtccaaacgtggaagagacacggaatccgatgcaaacactcagctggaagaaatgctcacatttttctcaaacgaatattccatctgcatttccatcagaaatcgaaaggcatgatctttttgatatattacttctcacgacaaaagggaccatctgcttcaagcgacagtccctctttttcgttcataggttctataatttttatttctactccgtctttaatgcacgcatggaatttaagatcgcaatgacagatactccgacatctgcaaacactgcttcccacatgttcgccacaccaaatgcaccgagaaccagcacgatcgctttgaccgccagtgcaaagacgatgttctgctttacaatgccgagtgtctttctggaaatccgcacgatcgacgcaatcttccggatatcgtcgtccatcagaaccacatctgccgcctcaatcgccgcgtcagatcccatgcttcccatcgcaataccgatgtccgctctggtgagcaccggcgcatcgttgataccgtcaccgacgaatgccagcttttctttctcgttctcttcttttaacaggcgctccacctgtgacactttatcctgcggaagcagttctgcatgcacctcgtcgatgccgagttccgcaacgattccctctgccgcttcttttctgtcgccggtcagcatgacacatttcttcacacccactttcttcatggaggcaatcgcctcttttgctccgtcctttaccgtatcggcaatcacaatgcttccgaggaattttccttctcttgccacatagacaacggttccgatgttcttgcacggctcatagaaaattgctttttccttcatcagcttctcattgccgatgagcacatttcttccgtcgattctgacactgattccgtgtccagccacttcctcggcatctgtgatacggttcatgtcaagttcttttccataggcttcccggatggatgccgcaatcgggtgattcgagtatccctcgccgagcgccgcaatctctaaaagttcctctttgcttccctcggtcggcagaatctcggaaaccttgaattcgccctttgtcagcgtacccgtcttgtcaaagacaatcgttgtcatttcagctacagcttcgagataattgcttccctttacaagtacgcccaccttcgacgctgcaccgattccgccaaagaatcccagcggcacagagatcacaagtgcgcacgggcaggagataacaaggaaaatgcaggctctctgaatccagtcgctccatcctccgccgagaatgagcggcggcagaattgccagaatcaccgcaccgatcgtgacaaccggtgtatagtattttgcaaaacgcgtgataaagttttccacgcgtgcctttttgctgctcgcgttttccacaagttccagaatctttgcaacggtggagtcatcgaactccttggtcgtctgtactttcagcgtaccgcttccgttgacacagccgctgatgatctcatctccggctgccgccttgcgcggaaccgattctccggtcagcgccgctgtatcaatgaaggactccccttccagcacaatgccgtccagcggaatacgctcgcccggttttaccacgatcatgctgccgacctccacatcatccgggtcgacctgcgtcagttttccgtccacctcaatgttggcatactccggacagatgtccatcatcgctgagatcgactgtctggacttgccgaccgcatatccctggaacagctcacccacctggtaaaacagcataacggcaaccgcttccgagtattccttcacgccaaacgcgccaaacgtcgccaccatcatcaggaagttttcatcaaacacctgtccgtggctgatattccgcaccgctttatatacaatgtcatatccgatgaccaggtaaggcaccagatagatgacaaataatatccatgtattgattccttccaatgcccccgtatgctccgccaccatcagggctgcgaacaggacaaaggatatgatgatccgaaccagcatccgtttctgtttcttcgtcataccacacacctcgcttttgattttcataaacatataaacatttgtttatatgtattcctttttctaagcctgcgcgccttccggcacacaggctttcatagaattgtctttcgttctctgtcaggcacacgcccgtgttattacattaagatcttgcagtccggctctacttttgcgcagacggaaacgacttctttcatgatgtcgtcgaacttgtcatcctctgcatctaccgtcatcttctgtgtcatgaagctgacatttgcatcattgacgcccggaatctttttgattgcctcttccatttttgctgcgcagtttgcacaatccagatcctctaatttgaattttttcttcatcgtcttatccttcctttctttttctttcttattcctaatatgttttcctgttgtacatatcctgttctttgcatcacataccgcccgctactcctcgatatgctctctgccctgggcgatgatcgtcctcacatgcccgtccgccagtgaataaaacacggactttccttctcttctgctgcgcaccagcttcgcctgctttaaaatcttaagctgatgtgagatggccggctgcgtcatgtgcagtgcttctgccaaatcgcacacacacacctccgcttcaaacagcacgaacagaattcttattcttgtagaatccccaaaaaccttgaacagttccgccagatcatataattcctcttcctccggcatctgatcgctcacaatcttcagacgatcctgatgaatctccacactctcgcaacattccagttctgcttcagacaacttctcaccctctttccttcaaacatatgaacaactgtttatatgtttataatatgctctgccatacactttgtcaagcatcatttttacaacttctggaaaaagatcaaataaaaaaaggctgtcggcaaacgacctcgattcgtctgccagacagcctccttagcaatgtgtatgctttgtatgtggttggctagttagttttatctaactgcatttactatagcacaatccgtcttctatagcaatactgcttattgaaaactattctcatttgctaattcttcttagcttctgccttcgccagaaaacgctcattgtcgatgataaatctctcgtgcgttccctcgccgatcactccggctgcatcgtatgcctttacctcaaatacaagccgctttctgtccacctcaaccagctttgtctcgcaggtcacctccatgccgaccggtgtggctgccacatgttttacattcatcagcgtaccgaccgttcctgctccctcttccagttcatccgccacacttttgtatgccgtattctccatcagggcaatcattgccggtgtcgcaaataccggaagcgtaccgcttcccatcgcctgcgctgtcttttcttctgttactgtaatggtctgtgttcctgtaattcctgcttccatttgtagattcatcctttcttctgcttttgctataaaattctgttttctactatatttatatcatattatcacattatgatctatcatgcccatttttctttcgcgaacggttaaagtatgcgaaagcaaaattgatgtcttttcccatataacaaaaagtcccggcgtacatcctaactaatgtgctccggaacttcctgttactattttgtactattcatatgacttcgccatgatacttctcacatgatgtccattcagatagccacatgccagaagtcctgactggatgatctgattccacttgctgctggagagctccacaatcgtgttgtcgtcaaattcgatcgtacatgcattttccatctcgcagtcctgatcgcaggtaatgcggtacatattctttctgctgatggctccgatctcctctagcgtattcaccatgcggtagacggtcgccgtaccgatcctgtcatccaatctggatgccttgtagtagatttccttacaacaggagcaatcctcctccagtataatatccagaagcatcaggcgctgtttggtgatgcggcagccgcgctcttttaacttctgtatgatattttccttctgcatctgggttctcagatatcttctgtcctgttccacttaagaacaatgtcctccgcagtttttacaatcgccgccgcactgcagggattttccgttctttttgtcatgaatcatgctgcgcacgatcaggcacacaacgattaccaaaattgctcctacaacaaatgttcccatatcgatcccccgctttctgccgaattactttgcctttacagcactctttacgtttacgttcaaagtctcgctctccttgtacggacggaacagcagataaatgaatccgatcacacaaaggaatgctacgactgtaccgaatccaaaatgtccggttgtgatcagtgtaccaatctggtagatgcacatggaaacaatgtaagccagaccacactgatatccgattgcaaaccagaaccactttgtattgttcatctctctcttgattgctcccatagctgcgaagcacggtgcgcataagaggttaaataccagatagccgtatgctgcgattggtgtcataacgcttgccaggttaccccagaactctgcaccatcttctgccactcccgcgaaaccgaacagcataccgaatgttgcaacgacgttttcttttgcgatcagaccgctgactgctgcaactgccatcttccagccgttgccgccctgtgtccatccaagcggtgtgaaaatccatgcgattgcggaaccgatctttgcaagaatgcactcagcctgtgccgcctcaagtgctgcaccttccagatcgccgaaatcaagcattccgaaggatccgtctgcccatccgaagttcattaagaaccacaggatgatggtcgataatgtgatgatggtacctgccttcttgataaaggaccatccacgctcccacatgctgcgcagaacgttgccgacggtcggccagtggtatgccggaagctccataacgaacggtgccggatcaccagcgaacatctttgtcttctttaaaatgataccggagcatacgattgctgcaactcctacaaaatatgcgctccatgcaacccatcctgcattgtcgaagaatgcacctgcgatcaatgcgatgatcggaagctttgcaccacacggaataaaggtggttgtcataactgtcatcttacggtcacgatcattctcaatcgttctggaagccatgacacccggcacaccacatccgctgccgattaacatcgggatgaaagatttaccggagagaccgaacttgcggaagatacgatccatgataaatgcaacacgtgccatatatccacaggactctaagaatgccaggaataagaaaagcacaagcatctgcggtacgaaaccaagtacggcgccgacaccggagataataccgtctacgataagacctgtcagccatgctgcacaacctgcattctcaagcagtgactgtgcgcccggaatgatccactcgccgaacagggtatcgttggtccagtctgtcaggatggctccgactgtagtaacagatacatagtaaactaagaacatgactaaggcgaagatcgggattgcagcccagcgattggttactacacggtcgatcttatccgatgtggacagcttctggctgttcttcggctttgtcacgcactcgccgatgatggaagaaatatatacataacgctcattggtaatgatactctcggtatcatcatcaaatgcatcctccagcttcttgatctcgtaagacacatccggaatgctcttcatctgctcgccgatcttgtcatcgcgctctaagagcttgatagcgaagaatctcttctgcgcctcatctacacttgatccaagctttgcttccacttcatggatcacatcttcaacttctttcgagaattcatgtaccggagttaccacacccttctgctgtgcaagtgccactgccttttctgcggccttcgtgatgccggttcccttcaatgcggagatctcaacaacctcacatccaagcttctggctgagcttgtcgatatgtaccttctcaccggtcttctctaagatatcaaccatgttgacagccatgataaccggaataccaagctccatgatctgtgtggagaggtaaaggttacgctcgatgttcgtgccatccacgatattgatgatcgcatccgggcgctcaccgatcaggtaatttcttgctaccacttcctccagtgtatacggagataaggaatagatacccggcaggtccatgatggtgacatccttatgtcccttcagcttaccttccttcttctcgactgtaacacccggccagttacctacgaactggttggaacccgtaagcgcgttaaacagtgttgtcttaccgcagtttgggttacctgctaatgcaattttaactgccattttctgctcctcttttcccgcagcgatttgtctgcgttatctttcttttatcattttctccgattttgattagtccgtgctaacctattatcaaaaaaaattactcgacttcgatcatttccgcatcagccttacgcagggacaactcatatcctctgaccgtgacctctaccggatctccaagcggtgcaacctttcttacatagatatccacacccttggtgatacccatatccatgatacgtctcttgaccggaccctctcctgtcagcttcttcaccttgacagtctgcccgcaggcaacttcctttaatgtcttcatactctgctccttctctgtatagttcatcatagcattgcctatgtctataccataatcttgttcgccatatcttttccaatggcaactctggaatccttgacattgacgatcatgttgccgcctgtctgggaaatgactgtcaccgtaccaccggtcacgaacccgagattctccaaaaactttctggtttcttccttaccgccgacttttttgatgatattcggctctccctcttttaccatagataacggcatcatttcatcctcttccttcgttcttgttgttgataatcattttcacttctattgcattggttagtataatctaacgttagttagttgtcaataacattgttgaaaaattttatcaataattatggtattggaaatctttgttagatcttacatttttttattctttcgaaagcgggactgtatatcattttactatatttatctttattacgaaaaaaacgcttaggctgtgaatcctaagcgtttttttcgtattcgtaaattattttaaatctcacttccatttgtttcaatcacatgcttataccaatagaagctatccttcttgtaacgattataagtaccttttccatagtcgtccgcatctacatatacaaatccatatcgttttgtcatctcagaagttgtggaacttacgagatcaatccatccccaataagtaacaccaaatacatccacaccatcctttatggcttcttttatctgctttaaatgcgcctctacaaattcgatacgtccctgatcgtgaatctgatgattgctgtccatactttcatacataccgatcccaaactcagctataaatatcggaagtccatagcgggtataaagctgatttaatgcaattctcagtccaaccggatcaatggaccagccccagtctgtcatcttcagataaggattattccggctctgatcaggaagcagccccgtaaatttcataggttcgccctgatactcagaaatattggacatataataactgaatgacaggaaatccgcttttcctttcttcaatgtctcaatatcttccggcgagtagtttctttttatgtttttctgctcaaaataccggtccagataatacggaaccacacccttgcattgaatatcatagaaataatagttgaggttcatatcaaatatctgctgcagagtatcttccggtctcacagttttcggatagtacacatgcttccataccatatttcccgcaagagcttcaggcgcaatctcatgtacaagaatcactgctttcgcactggccagaagcatattatgtacaacctcaaacgtaagctgttcttcgtctaatccttttaacgaatgatcgcgcatagctcccgagcaggtagaaagactctgaagactcatattgatttcattaaacgtcaaccagtattttacttttttatgatatctttctacgatagtccggacatatttttcaaacaaagcaatcgtttctcttgactcaaagccattcagcttttcacagactgccagcgggaaatcataatgtaacatagtgaccaacggttcaataccatatttgtgacactcatcaaaaaccttgtcatagaatgccagtccctcttcgttaggtttttcttcaaatcccgtcgggaaaatccgtgaccacgatatggacatacgaaacactgaaaatcccatttccgccatcaatgcaatatcttctttataatgatggtaaaaatcatttccccatcttttcggaaatatataggtatcttcatgtgcttttgcctcttgcagagatgcgtaggtctgctcaaaggtagcctcatccgcccgccgctcatttggtgctacatacttcaggaaatcggtatttgcaagccctctgccgccttcattataggcgccctcgatctgattggctgccgtcgctcctccccaaaggaaaccctttttgaaacttttctctcccatgttacttttccccctttttcatatttttcaggcactgatacagaatagaaatcatatactgttcgctttcaaccgtcatcagtgtatcctgtgcatgggaaaataacaccgtcataggaacgctgtctccctctgcttcattctggaggacagatgtctgcgccttatgcgcctctaccaattccgcagaagctttctttagaagctcctccactccgtccaaatccagagccgataatttggttcctgctttcctaatataatcccgggcatctcccgcatgcataatgacattcatcgctacctgaactaatttttcgctatccatttttctcctcttttcttaaagtatttacttcctgttcactctccagttcctgtttttcataaactttgaaaaacggaagatatatcaaataagtcagtacaaataaaaccgcccaaagaataataccacgaaaatcgctgtttaccataaaggtggaaataggctgtggcaggaagttcatcatcatggcaactgccggaatagacaccagtcccagtttaaatacaatataggtaatcgtaggaacaacaaaggatactgtcatatatccaagcatcataaccggatttaaaacaaccggcagaccatacataaccggctcgttgatattaaaaatagaagaagcaatcgccgcttttccaatggtactaattttctttgacctggaacggatcatcaaaatgttcagtggaagtgtacatcccaatcctcccagacaacaccagcccatgaaaaccaattcatcggtagcaatatagatcggagcctggcctgctgccacagcagccgcatttgctgcaatattagtcagatacaacgcacatacgatgggccaaaccgtccacgccgagagtccacagcaataacacaatgccataatcatatagaaaagcaggaatcccagataagtatttccgattgccgcaagcggactgaacactttttccaacagtgaaaataaatccacgttctgtccaatgatgatacatactaaaatcaaaacaaaaatgatcaggatagactcaaaccatacaaccactaccgacggaagagaactgtccttcttaaacagaccatgtttaaagtaagcagaaaacagccagccaatcaccagccccatgaccattgctactgtcatgcctcccgtcccaacatagccggagtttattacgagatttccatccacatactgaggatttgccagtgcaatcaatgcagatacagacgcaaatcccgttatcattttttgcttctggagcttcttgctttccataatcgtgtaaggaatcaaaaacgccataaaaatggaaatcagcccaaaggaaaaagaattgatcaggctcagatccggaagccatggagcaaagttccgaaacgtattaaccagacttgccaatgaaccaaccataatcataggcagaattatcgtaaaacacacctgaagcgcatgcatatacgggttctgcataaacttctgcattttctgtgaaaatggacctgccagccaatcctgtaatttcatataaaatttcatatgtactcctccttctcaaatcagatttttcgcaagctcgaaacattttgttccatccagtgtggaaaatgcataattgtcaatgatcgcatattttttcccatgttcctcacaggtttcacgaatcatctcctcattacatttcatctgaggcgctgccagtaccacatcaaagtcatcaatgacctccggcagttctgtataactgtaggcttccgtgtctacatcatacccctgggcttttcctgcttttcctgtccgcgatgcaatcattccgctggatacgccgtttccacaaataaataaaatcctcattacattatccccttcctctgttatatttttgatgaattcattatccattattttcaaacttatatctatcctccgagcttcctacccactaggaaaggaatggattgatatagataatctcttatattataataaataagattaaatttataaaatacaaaaagctgctggttttataatatattggcacctttcacagaaaggcagattataataatgaataaccttcaaaagctgcttacagttttaaaacaatcagatacaccgctttcgtcacggcaattgagctctttgctttctgtttccgaccgttccgtccgtaactatatcaaggaactcagaaacgccggtgaacaaattaccgcaaatgaaaacggctatctctggatcggaataaagaacgatgagcctgacagccctggtaacaaatcgcaggctttatttgcattcgccactccggaggagcgtattaattacattattgaaaagctaatactggccaaatccggccttgatttatacgatctggctgactctatttacatcagctattccaccattgaaaaagatatgatccgggtaaaaaagaaactcgcccttttcaatctgagtattcaccgccaaaacggaacaatcgatattgtcggtgaagaacatcataaacgagctctcttttcccattatcttacctcgaatctggattctaccatagatctgactttagagtcattctgtaagcttttgaatatttctccagattctttgcgggcaattgtccatgaagccttgcagaccgaaaacctttatgcctccgattacgctttcaaaagcattattattcatgtcattatcaatatgacccgtatcaaaatcagggaatgtctattagaaaagccactttacgacagcgtgacaattcacactgccgaatatcgtgccgccagccggatctttgaccagatctcgcgcttatgccccatacagtttaacgaaaatgaactgcagcagctggcattcattatcatgacaaaaacaagtgcaatcaacatcaataatgtcattgacctgccccggattgtggacagcgcacttattcagtttgtcaatgaaattataaaacaggtaaaaaccatttactatattgatttatatgacacggattttattaattttttcactgtccatctctccaatgcactatttcgatgcaggcacaatgtttccatccggactcccttgtcagatgagatttttattcagaatccgttaatttacgaaatcgccgtttttattgcacaagaaattaaaactacttttggttatgagttaaataaagatgagataacttttatatctcttcatgtaggtgctgttcttgggaaaaaaatggatgaacatcccgaaataaaggcagttctggtagtaaataattattataactattacaataagcattctctggaatccattactcaaaaattatccggaaaatgcaaaattgcggaggttactaacactctggatgacgttaatcctgcttactatgatttgattattgatgccacgaatcaggttctgccacaggccaatctcagagtcatacaaacaaatacaattattacagagcatgattttaaaaaaatacaatctgcctgtaacgaacttctggctgaaaaaaaacgcagaatattccacgataaactaattagttttatggatccgcaattatttgaaaaaaatcattacgaaaattctgtggaagatatgatacgctatatggcagaaaaactggttgctctgggtattgctccggaagcttttactgactctgttctggaacgggaggctgttacccccaccagttttgacaacaaagtggcaatcccacattccatcgtctgctctacccaaaaaaatattggatttgtaatcgttaacgaaaaacctcttcgctggggaacctttgatgttcaaattattatgatgatcggcgtcaaccatcagcagcgtatggattttaaatatgtctattctaatttactggagcattttgagaacagcactaccgtagaaaagcttatccacgcatcagattttcataattttattgacatactgacctcctgatcctaatttttatctgtcctctaatctggaaataaacagactgccaaacatatatttctcagtcaaaaaaataaagtgtgtaagttttgttaacaccaacaacttacacactttattttatgttcttatcaaactccgtcccttccgggacggagttttcatttctgatctgtgttttatttctcagcacgtgcgattgcaaccttgaaatccttggtatctgcaaagatctcgttcttgtaaggattcttcttctgctcgattgcgcgcttgatgattacgcttaagcagatgacatttgcaaccaatgcaatgattgccatgaatccctgtaccttggtgttcggtgctacgctggtcagatccattgtcgttaaggagaacgcatccagagactcaaagccctctacgttagagtagagtaccggaagtacagagaaacgtcccttgatctggaacatcggaaccacctgtgcgaacatacaccaggttgccagcgtattggcacggttctgaatccagccacccttgttccaaagtgcatttgcgaatgtcggtgcaagaagcagagccagaccgcaataccaggaatgcgtcggcaggttattgtatgtataggtaaagttccaaagatcatatgccacgataaaccataccgtcatatccggccataacatatcctgatgattcttgtccttggatgcataaattccccaccagcctgtcatacagaagatgttgaggatacctgcgataccattaacccagttccaccagccaccgttcagccatacatcctcgatggaataccaccagccattgactgcctgtgcgcctttgattgcggactcaaaatcagaagcaactgcaatcatgatgttgattgcaacgattacaaacggccaaaccttgaaccaattggtcttaccgatccactgcttgtactttaagaacatgaaaccgatgcatccaaatgctgctgcatataactttgcataatggaaccagccacccatatatacataggtatcattggttgcaccccagccaccatttgcggcgctgatctgaatagcgataaagtatacagtaagaattgcaagaactcctacgaaaataccataaccgccaagttttgtgcggcgctcaatctcatttaagattacaagtcctgcaaatacgagaacccatcccaggagctgccacatgctgttaatctggaataacataactttttcctcctttgtcttattaaaaatatgatactccctcgaaccgtcatgccaggtatctggtatgaccagtccacaaatgaattttaatactttttttagaaaattacaagtatttttacaattattaacaaaatctggtatgaccactgttcagaattgcctgttatcccctgccggcacgcattttctgccggttcatgctatcttacgccttctcatccaccttgattcccttcagatccgcttcaagcactttcatgctgctcttgatgtcgcccaggttctgatccacactcttcttcagatctgcgctgtccgccagatccaccatgtccgtcatctgaatgtccgggctgtcattctggcgcttgatgcgctccgcctcttccactgcttcatcggttccctcgatcatcgcgcgctcaatcgcgcgctccagcttcatctcatccagcttttcctcgcgcttttccctctccttcatggcttcgtcggctttttccttcgcctcgtccatcttctcatcctgctggtcttttacctcctgcacaagcattccgataatctcgtcgtttgccgcatccatgatgtcatccgcagctccctgcgcgtcaaccatcgcatgcgtcttcaagcgctccagcttgatacgggagacgttctgtttctccgcagtcataccgtaatcagctctccggatctccctcttgtgatccgccgcataattgttcagctccagcgcctgcttctgatactcagtcagcggctttttgtggatctccgccagtctgtcgtattcttcgtccgtcagcccttcatccagaacgccgttcttataatcctgttctttttccagaaggagcagatcctgctgctcctgggaatccgcgtccacgccgcactgctcccgcaatgtttccttctgccggttcgtcttatcgattgcagccagtgctccctttttgcggttctccagctccgcgtagctgtcccggtggctctgtatggtgtcatctaccgaccggtcatttttccacgcattttccacaaccttccacgcctgccgtctcgcttcctccctgcgctttgccactggatcttccccgagctttgtcgcgccgccgaacgctgcgttttttactgtccgtacgctctgtccatcctttgttcccatatggacactgttgttaaaacctgccgcattaactgtcagtttcatactcattttccccccgtatcaaaccagaatacgtctccgtgtgttactgctgctcctccgtctgtgtcagcgcgatcagctcctgtgagcgtccggcgatcgttaaaagatgctgcatattttcttgctccgccgcaagcgtctcgttcgcatgtgccgatacctcctccgacactgccgagatcgtctgcacggaatcagcaatctcctgatttgccgcctcaagctgtgaaacgctctccgtcagtctcgccacattatcgcggatcgcataggtatgttcctcaatcgtaccaaagcttgccgacgcatttccggacatttccttttcctcattgattccgtcaatcatctcacggatgactgtcacaacctccgtgatagaaccggacacattgccgatcagctgtgtgatgttggtcgttgcgctcttggtctgggttgcaagctccgagatctcggatgccacgaccgcaaacccttttcctgcctctcctgcgcgtgccgcctcaatacttgcatttaacgccagcaggctggtctgggaagtcacaccgttgataagttctacaattgtattcatctcactgatatactgattcagcgtctcgagcttatccgcggcattggcactgtttcgcacagatacttcaacctctcccaccagggtatccatatccgcttttcccttttccagcacagaaagcgtcttttccatgcgctcggtaatatccgatgcaaccgtactgacaagccctactttctctccgattgtctccgtctgtgccagctgtctctgcactgcctccgccgtgtccgtcgcgccgatggttacctgtcccatcgcgtccttggtcgtctccgatgccgactgcagctgctccacttttgcatggatctcattgattccgcgtctcatcacatccgcattccgggagacatccccgagaaccttttcggtctcgccctgcgcatcctttacctgctgcagcttctccctgctgttcgtctcggaagtcgccgctgcgatataggaatacgcgcagaacaaaagtaccgccagaatctggatcacgccggaactcatatcacggaaaccgaatctgccggttgtcgctccaagaatcacaaccagaagattctctatcacaaccccgatattgaccttgagggcatacgccttgtcattgtatacggaaatcacaacaatcatcggaaatacatacaaaaacagcatgttgttggtcgtcgtaaacaaaatgaccgtgtacatcacagcgaatccctgcgccaccaggtgcttgatcgccgggctttccttgtccctgctccagaaaaaaagctccatcagaggcggtcccatcgccagcacaacaaccagcagagagtacagcagtcccctgctgcccaccagaagctgtgcgataaacgtaattgtaatcatcgacgcctccaccagatggcagatcatagccgtccggttgcagcgcgccatatcagataacgttcttttgtccatttgtcattcctccgtacaccttgacaccattcttttactctaaagtatcatttttttcgccctgtcgcaatatttgtaataaaaactcgtccaatttttaacattttttgaaaattggacaaatccaactttcttttctgtcacatgcggacgcgctcacgcagctgcagcagcagctttttttccaggcggcttacctgcacctgactcatcgacagcagttctgccacctcgcactgtgtctttccctcgtagtatctgagttgcagcagacggcgctcacgctcgccgacggtctccaacagctgttccaccagaatgtggtttaggaccgcttccttctccggctcctcccgctccgcgctctgccctccgcttccctccatctgatcgatcagcagcagctcctccccgtcgcgctcatagaccggctgataaatggacgccacctcccggtttgcctcaagtgccagcacgatctcctcgtgctccagcccggcggcttccgccagttcctccatcgtcggctctctccccagttccctggtaagcatttctcccgccctgcggattttatagccgttctcctttaaggttctgctgacttttaccataccgtcatcccgcagaaaacgcctgatctccccggtaatcatcggtaccgcgtaggtggaaaaggcaagctgcagcgatacgtcaaatttgtcgatagccttcatcagcccgatgcagccgatctggaacagttcctccctgtcatgtcctctgtgttcaaaacgcctcgtcaccgcgtgcaccagtcccaagttttctgccaccagccggttccttgcgtccttgtcccccgcgtgagcctgtctgatctgttccgtccaaagctccataacgttcagccttcctgcacgccaatgtattttttcatgcgcacgctggttccttttccgggcgcagactgaacctgaacttcatccataaacgcttccatgaacgcaaatcccatcccggagcgctccagttccggctttgtggtgtagaacggttccattgcccgcgccacatcctcaatccccctgcccgtatcacagacgatgatctccacttcccgtcccatgatcctgcatgtcatatgtaccttttcccccggattgtcatacccgtgaatgattgcattggtcaccgcctccgacacggccgtcttgacatccgagagttcatccatcgtcggattcagctctgtgataaacgcagccaccgccattctggcaaatccctcattgacggaacgcgcatcaaaacttaattccacttcattcttactatgcattgtgattctccccttcccgctctttctgctgcttaggtacgcttgtccgtatcagcgtgtgaagtccggacaccttaaaaatcttaaggattctgccgcttaaatgttccgcatacacctcaccgccaaaatatcccatcttccggctccgcccgataatcaccccgattccggagctgtccatgaactccgttcccgcaaaatcaaacacgagcgtcttcacctgaccggtctcaataaagaaatccgcctcctgtttcaggcggtctgcctcatgatgatcgagttccctcgggacatacacccgcaggcagtttttttcctgttcgcaatatctttccatcctttttcctccctttcttttctttatggcatttttgtataataggaacaaagtttcctatgaaacaaaaaagacgccggtacggactgctccgttcgacgtcttttgtatcataattcttttgtcttatcactgttgtgtctgtttgcgcagtaccctgcttcttcctgtccccgcttattcttcggtgttcagatacctctgtgcattggcagcgcgctcggttcccggatacagatccgcaaacttctgataataggtcttggcattgtccatgtcgtcattcctgcggtaagactgcgcaaggtagtacagcgcattgccgttgtcgtaggtttcatcgagttcgatcaccttgaggtaatcctcgattgcctgtgtaaactcctgcgcattgtaagcatctgttgcttccttatatacggcgctgatatactccgcgtttacctgtgcattgatcgtatcgtacacagtcatggagtcatccgaaagataatcggtattgacgttgccgagtgccgtccccgccttctcgatgtcaccgtcggtgtacgccacatacgcctgcagaagctgctcgtaagtgttgacctttccggcgctgctctcctcctcgttcttcgcatccgtgatctgtgatgtgagatcttcaatctgcgcttctaaggaactgatgctctgattcttggatgccacggcattgttggcgtcaagaacctccgctttcgcctgattctggatctccctgcgcactcccggcacaatcagaaagcaggtgatcgccgcaccgattgcaattccgatcaccatattgatgatcgttccgattgcggaattgtccttgagatagcgcggctggatgatggtctcattgccgctctgataggagatcagatcctcgttcttctgctttttcgggttattctcacgcaatccggcgttgacttcttttaaatagcgcagcgtcgtggtgttgttggcgtcaatttttcccgcattccgaagcgacttcttggcaaggtcgtacttcttctcctgaatgtagaggagcgccagcaactgatgaccgcttaccagcttcggatttaaggacagcactttcttgagctggatgatcgccagatcccggctgtcctgtctgcagtacagcagcgcctggttgtattttttgatcgtctggttgatcgtatccagccttgacggattgttctggatctcatttaaataccggcttgcggcgttgtccctcggctggtaattcttgctgatgacccactccgtcaacgcttcgaccacctcgcccgtctcgaagtagaccagtccgagcaggttgcgcgcatcgatattcatcttataaaaacgaaggctggtcctaagactctctatcgcgccggacaggtcccgcactgccgccttctctaacgcatcattatagtaggcattggacgccataatgatctttttgtatattttaacattggctccgcagttctggcagatatcgcccttgcccagcttcgccccgcaattataacattccatggaaaacctcactttatcaatcctgaccctgcctgcttctacatgccgcgcttcatatcctgcaggatctcctgcaatacgtccgtcatatccgtgagttcatgattatagatagcctgctccgcctcttccacttccaggctcggcttaaaattctttaattcttcttcaaaattgatcactgttatcacctctgtcatcaatataaaaacaccactatattattcactttctcattataatatagtggtgctaataatcaagctatttttgacgcagaaacttctgctattcgacaccggcgctgcacggtcttgttccgatcttgtccggtaatttgtaaaattccactccggttgccatatttttcaaggcaagcttcaactcgtccatattgatgaccacaccgggataaatctcctggagcaccgagacacaagccccttttgaactctctgcaagaatacggagcttccgcacttcctcctcgtcgctggcaagcattgcagaatccttgatcttaatccgaagcagcgacgtccggcgcggatcgttcgtgtagctgacgccacgctccttggagagaatctcgaacttctccaatccttcctcgatcttcgccagttcctccctcgtcatctcgatcttcttctccatgacacgcaggcggctgtacacatcaattccggcaccgacaaagatctcggtgcgcttctcggcatcattgccaagcgaggttgcaatcagtccgcggatcgcctgtaccttaccgccgataatactgccctttcttccggtcagacgtatctgcccatggcagatcaccgaacaatccatcagcacatccgcctgcagatcaccctcacacagaatgttcgtgaactcaaaaaacttcgcagtaatcgcgcccttcgtcttcacagacgccttgttgccgccgagcataccgcctcttaggatgatgtccttgccggcttccagcatgcacgcttcggcgacaccgtcgatcgtgattgatccggttgcccggatgttgacgccgctctccacattcccgtgaatgacaatatctccgcggaagtcgatattaccctctgctagctctgcattccccgagacttcatgtaccggaagaaccacaatccggtcattctgcatctcgatcttaccgtccatggaagccgtataagttacctcatcgtccatacgatcgaaacctttgccctttaacggcatctgttctcttccgtgcttggcaggcaccagcctgcccttgaccgacattccatcctcgccagacacagcagggtgatacacggcaatcacctgaccggcagtcacagactcgatcgaatgtaccgaccagtaatccacagaaccgtccggcagaagcttcggcttgccgtcaaagttcgtgtcgaacttgtattcgtagtaaccgtccgttccatccaccggcttcttcccctgcgcgaccagaagctctgcattgtatgtatgcccctccagcatatcggaaatccgctgctcatctatgcctgtggtgattcctctcgctgccatctcctgccggatctgggagtccgtataccctgttccctgttccggctccgggagcagcatataggcctccatctcatcaaatgttatgcgtataataggtttctgttgtgtaagttccgccatagtctgccgctccccaatctgtgtaaatcccacctgctactgtcaatccatctacattctatcatactagtccgatggtactttttcaagtacatctttttgcgtttccggtacaatacgcagggtttctctaactcttttctagcggttcatctgtgcgagccgttcctcgacctgtgccatcatctgctcgtaccctgcgagtttctctttttcctcctgaacctttgcctccggagccttgcttaagaatttttcattggaaagcattcctctggaacgggcgagttctttggtcagacgctctttttcttttaagaggcgttccttctccttctcaaaatcgaccagatcctcaagcggcagatacagtgttgctcccggaattacgacagataccgcatcatcctcgattccgttcttgtctgcctgtacactcacatcgcttgcgcctgccagattctgatatgcctctcttgtcttctcaaatgtctcacgcagtgcggcatcgtctgccacaatgaaaatctttgcttttcttgaaggcggcacatccatctccgtacgcacgttgcggacaccttttaccagatccttgcagtgctctaacatctcttcctctgccgggaaattccagtctgcgcggtactccggccattttgccagcatgatcgtctcctctttgggatgcagtgtgcagaaaatctcctccgtgataaacggcataaacggatgcagcagctttaacgcctctgtgagcaccgtctttaatgtccagaacgccgcatttgctgaaaccggatcctgctctttgttgtaggtgcgcgtcttggtaatctcaatgtaccagtcacagaactcatcccagatgaagtcgtaaaccttctgcactgcgattcccatctcgtacttgtccatgttctcggtcacgtccttggcaagtgtattcacctttgagagaatccacttgtccgccggctgtaactcatccgcggacggctcggttatcgcagccccctccagattcatcatgataaaacgggatgcattccagactttgttggcaaagtttctggatgactcgactctctcccagtagaaacgcatgtcgttgcccggtgcatttccggtaattaacgtcagacggagcgcatctgcgccgtacttgtcgatgacctcaagcggatcgataccattgccgagcgatttgctcatcttgcgtccctgggaatcgcgcaccagtccgtggaacagtaccgtgtggaacggcgcttttcccatctgctcgtaacccgagaagatcatgcggatgacccagaagaaaataatgtcgtaacctgttaccagcacatcggtcgggaagaagtagtccagatcctcggtcttcttgggccagcccagtgtcgagaacggccacagtgcggaggagaaccaggtgtcgagcgtatccggatcctgctccatgtggccgcatccgcacttcgggcacttctggggcgcactctttgccacaaccatctcaccacagtccggacagtagtaagccggaatgcggtgtccccaccagagctgtctggagatgcaccagtcgcggatgttgtccgtccagttaaaataggtcttctccatgcgcttcggcagcagctggatatctccgttcttcactgcctccactgccggtttgatcagctcatccatctttacaaaccactgctgcttcaccatcggctctaccgtcgtaccgcagcggtcgtgtgttcctacattatgagagtgcggctccacctttaccagaagtccctgctccttcaagtcgtccaccagtgcctttctgcactcgtagcggtccatcccctcgtattttcctgcgaaatggttcatcgtcgcatcgtcgttaatgacggtgatctcctctaagttgtggcgctttccaacctcaaagtcgttcgggtcatgtgccggtgtgatcttcacgcagccggttccgaactccttgtcgacatatgggtctgcgatgaccggaatctcacggtctgtcatcggaagctttaacatttttccaacgatgtccttgtagcgctcatcgtccggattgacagcgactgcggtatcaccgaacagcgtctccggtctggttgttgcgatctcaacgaatctgccttcctcgccgactaccggatagttgatgtgccagaaaaatccgtcctgctcctcatgctctacctcggcatcggaaatggaggtcttgcagaccgggcaccagttgacaatgcgggagcccttgtagatcagtcctttttcatataacttcacaaatacctcaagcactgcgtcagagcagcccttgtccatggtaaaacgctctctctgccagtctgcggaggaacccatcttctttaactggttgatgatgcggctgccgtactcgtccttccactcatagcatttctcgagaaacccttcgcgtcccagatcgtgcttgtcaattccctgctttttcaggttctcaataacctttacctcagtcgcaatggaggcgtggtcggttcccggctgccacagtgcattgtacccctgcattctcttgtaacggatcaaaatatcctgcatggtgttgtcgagcgcatgtcccatatgaagctgtccggtaatatttggcggaggcatcacgatggtaaacggtttcttgctacggtcaacttccgcatggaaatagccgttgtcctcccattttttgtaaagtcttccctcgatccccttcggatcatatgtcttggcaagttctttgctgcaattctggcacattgtcctctctccttttctttcctaattacataaaaacgccctttgtatccgtaaggatacaaagggcgacttatcgcggtaccacctttgttcaccagctgtatacagccggtcttcgctccggtcagatgctctctaaccagcggttcgttaacgggaaccgggcgtgaacacttgctgccgtacatcttctgtaccgctttctgggtgttccggttcaaaagctaccttccacgcatctccttccaagaaaccttgcagccgatgggtctctctctctgcggcgagtctgcatgtactcctctttctctctaccttttacatactgttaatgatacgtgcagcgtcccgttttgtcaagaaatttttagttcagactcttcaccagcgcctcatagacaaagcgcttcgcctcttccctgcttaccgccatcttctctcctttttccagatcgaccaggtatcctgcaaacgctgtcatctgcgccacgaacgccagcttctgcaagtacggattcgtctccccgatcgtgccttccgacacgccctggcacatcagggactccacaatcctatccgccagatggcagcccagagcctgctgtctcttttcacattccctgcgcatggactcagagacctcatacgaaccagttccgatccgtaccagaagacagaacgcctgtcgcttcgcgaacacctcttccatataagtaagaatctgtacaaattttcctgcaaaatctccctcacctttggtgatttccagtacgtgcgcaagccgcatctccacatcgtagaggaccgcattcgcaatgatctcctccttggaggaaaaatactcgtacgctgttcctttgccgatccccgcctgcgccgtgatgtccgacaccttcatgcggttgatatcccagccgtcggttaccatggcaagcaccgcctcgtacagcagccgcactttctccggcagtgccccgttttcatatctcccattcattataattcttcctccaccatatttttctccctgttgaacgcgtcatagatacacggaaccacaaacagggtcagaagcgtaccgtaaatcaggcctccctcggtcacaattgccatcggctgcatcatttccgaaccgtcaccgagtccgagcgccatcgtggacatcgacaggatcgtcgtgagcgctgtcattaagatcgggcgcagacgcgtctttgctgaatttaagatcgcctcttttttcgtcatgccgcccctgcggagctggttgatgtaatccaccataacgataccgttgttgacgataattcctgcaagcatgacgaatccgatcattgcgacaacactgatctcatttccggtgaaaaacagggcaaacagacctccggtaaacgccagcggaatcgtgaacatgatgatgaacggagacaggaatgactggaactgtgccaccatgatcagatagataaatacgaccgccagaatcagcatcaggtacaactgctgcatggcatctgctatcatctcatcctcacccgtcatctcaattgagtatccttccggcagatctattttattcagttctttcatcagtgcgtttgcgacaagcgtgacgttgtgtgtgtcatccacacctgctgtgacgctgatatagcgcgtctgggaatccctggacactgcgtttaagctgctgccagcctcaaacgtcgcaatctcggtaagtggaatctcctttaccgtatccccggtatccccggtatcttctgtgtcttcgatatccttggcatcccctgtatccttggtatcctccgacagtttttcgtccgtctctttctccccgttgctacccgtactgcttaactgcgccatcttatcctcgtaggaaaacgtgaggttcttaatatcgtcgagcgtcacattcgcctgctcctcgctccttacatacacctcgtaatcctgcacgccggcagagatcgccgtcaccgcggtctgggacgccaattttgcatagaccagctggaatacctgcgctgttgtcatgccgtattccgctgccttttccttgtcgacatgaatcgtgtaggactgcgtcgtattatccagcccgtcatccacatccaccgttccttcctgtgcttccaccacaccggccactttccctgccagttcctggagggtgccaaggtcacttcccttgatctgcaccgtaataccgcttccgaggaaggaactcatatccgacgccgaattgtccgtgtcaacctgacagtccatatctttggtcagctccgcaatctgcgccgtgatctctcccgccgtgacggaggaattctcatccagaagcagatacatcgtcacactgtcactgctgccgcccatggacatcagggcgctgtctcctccggcgatcgctccgatcgtctccacgccgtcaatgcccgcaatcttctccgtcacctcatccgcgcgctcgcagagttcctcaaacgtcagtttttcgtcctccttcgccgccactgtcacggtcaactgatcggtttccatattcatatccataaaggaaaatcctctggaatacgcggcaagcgcactcgtcacaagcaggacagtcacaccgatgaacacgaccggtttgaacctgagtgccagttccaaaagcttcgcatatccctgctgcactttttcaaagaaggcgtgccgcacctctttgggatttttaagtagtcccgccgccatcatcggcacgaacgtcagcgccacgatgaggctggctgtcaatgtaaacgtaattgtgagtgcgatgtccacaaacagctgcctcgtgattccctctgtgaacacaatcggaacgaacacacacaccgtcgttaaggtcgatgcaataatggctccggtcacgccgccggctccctcaaccgccgcctttttgatggaatatccctcgctccgcaggcgatagatgttctcaatgaccacgatagagttatccacaagcataccgatgccaagcgccagtcccgacaacgagataatgtttaaggaaatatttgaaaaatacatcaacaccaccgcaaaaataacactgagcgggatggagcatgcaatcacgagcgtcggccggatgtcttttaaaaacagaatcagcacgatgacggacagcagcgcgcccacgatcatattttccaataccgactgcacaatgatatcgatataaattccctgattcatcaagatcgccgtgtgaagtgcgggattatctgcctccatcgcctttaatttctgctggatccgctttgtcacatccccggtcgagtacccggtctgcttttcaatggaaagcatgattgcggggtttccgtttaccttggaataagactcaccggcgttgttcaccagttccactgccgccacatcgctaaggcagactggcccgattccgtccagaccaagatcaatcaaaaccacctgctttaattcgtccacggaatccagcttatcgcccacacgcaccatgtagcggttctcgccttccccgacatagcctgccggcatggaaaaattctgtgccgcgagcaggttaccgagcatgtcgaccgtgagaatctgatccagatccgcagattcctttgcgctatcctttgccgcatccagctggctctgtccctgcgccagctgattctttgcatcggcaagctgcgctgtcgcctcgctcagctgcaggattccctcaatctggttcttcgtcagctgcgcggaggcttcatccagcgcaattttacctgcgtccacctgtttttgcgcctcctgcatggtcgcaattcccgtattgatctcggcaagcttctgcgtcatatctgcgattgcatagggcagatcatcgagtgtctgtactttgatgccaaggctctccagctgctgtccccatgcggcgatcgattcattgattgttgcaagctgtgcatttgcctgctgctcgatctgtgcgctgcctgccgcaatcgcctcctgctgttccggtgtcagcatattcttcagcgcttccagctgctgtctggctgcaattccatcattataaagctgctgcagtgccggaattgccttctccatgatcttttttgcctcagtcatcatggtcatattcgtctttaattctgatgcgccgacatacgcctgaatctttccattttcaatctgattggctgcggcactgacctggtttgccagttcgctcttgccactctccagctttttctcgccattttccagctctgcggatgcatcatccagttccttctgcgcatctgcaaactgttcctcgatcttttcctgaatcttatcattcagagcatcgattttgtcctgatccatggtcacctgcacggattcctcaagcacgccggtagcgcttaccgaagccacaccctccacgctctcgagtgccggtgaaaattcattttccacataggaagacacctctgactcatccatgccttccacatccgccgacgccaccatgaccggcatcatatccgggtcgatctgcataatcatcggctttccgacgctgtctgaaaaacttccctccagctggtccagcttctgctggatctcaatcagaatggaatccatgttggcgctctgctcgtattccagaataaccatggaatagttgtcgtacgatacggagctcacgtttttgatgctggatgtcgtcgccatggaggcttcaaccggtgccgtcacatccgtctcaacctcctccgggctcgcgcccacatccgttgtaattaccagcgcatagggcaggttcatatccggcagcagatcagtcgtcattctggtaaatgacaccactcccagaacgatcaccaggattacacccacaatgacagtgtacggtctttttacactaaattttgaaatcacatctgtatcctctctttgactttgtattccgtccgaccagtcggtcggcttttgacattttttatgctgcgcgagaatctttcgattctccgcagcatatctgcgtttgtctattctgctgtcttacgatacttattcttcctcatcgtcgtcatccgcaattgccgccgctgttccggctaccgaagaagccaccacaaccacgaccacaattacaaccagcagcaataagatccccataaagatcaaaaaacccgtctctgtcattctccttctcctcgtctttctgtcagcagatgccgcacatcccgccgcacctcttccggcataatctcactcctgatgcaagtatagcatatttacacccgcatgaaaagtcctttatccggcctgttttgtgaagaacttctgtgtgaattccgccctgctgcaaggttttccgaacagaaacccctgtatataatccggctctgtctgttttgcctttgtaagttcgccctctgtctcgattccctcaacgcatacgtgaagccccaggctgtgggacatctccacgatatgatttaaaagccggtactcatattcacggttcagcgcttttaatgtgaacgaccggtcaatcttaatatatgcaggctttaaatcgcttaaacaacgcaggttggaatatcctgtgccaaaatcatccagtgccagcaatacaccgtattctttgagtccgttccagactttgtcaaagcgctcattctcctccagataaccgctctctgtcagctcgatgcagacactcgacggcttgactccgaactcatcaacaatcctgcgcacatccgtgagaacacggctctttaacacctgcacataggacaggttaacattcaccttgaactccggaagaatcttctgccattccctgcatgcatccagcgcctggcgcagcacccacctgccgaccggaataatcagaccggattcttcgagaatcgggataaattcgccgggcgataccatcccaccctccggtgaatggaagcggagcagcgtctccgccccggtcagttcaccgtttgcagcatttaccaacggctggaaatatgcctcaaatccctcaaatccattatttaccgcatgatgcagctgccgcagcagtgtgcggcttttcagataatcttcgtattcctcctcctcaaatacatagcagctgttttttccgcgctccttcgcctcgctgagtgcaaactccgaaagcttcatggcattttcaaaggaattgtccacatcgccgttcttcacgatacctccggacaccgtatacaccgctttgtactggttctgctcaataaatgcgtagatggatttcttgatctcatggaaaagatcttcggcctgctgcacactgccgccggaaaaatccacaactgcgaactcatccgccacaatatggaacaggctctgttccgggcctatattttcctcaatacactgtgccgttcttcttaaaatataatctccgtattcgttgccgtggctctcgttgatgttcttgaaatcatcgatgccgattctgagcaaaaatccctgtggcagctttggactgcggctctcataaaaaatcttcagactatattctcccaacaggccgctgacattgtccgccttctgttttgccccgatctcattgatgcagcccacaaggtatctgggtgatccatcctccggatcgctcaatactctgcccctgcagttgatccagatcgtttcatgattcttccccatccagcgatagtgcagattgtggaatactttcctgcccgtggagagaagctccagctctaccagcagcaaatcaagatcatccggatatacaacctgtctgtgcatttccactacattgtgaaaatgatctgccggcagacaaaaacgcttcaccgcattcggtgaaatctggtaataatcttccttaaaatcacacacatacaagtaatcatccatacaagggcttaaaagccctaccatatcaaccatttgttccgtcgtaaaatgcgccacttccgccttcatcttagcacccccagatcccgcatctatcgtactttagtcttactccatactacataattttctgaaaaaagtcaatcacagggcagaatatctgcacaacagataccgggatgttgacgatgtctccacaaaataaggctgtcacgcgaacggacggctatgtcatatattacactgaaaaaatcggaaaggacaacgttccagatcaaacccggagcgtggacattcggagcgcaaaatacggaatttctaattctgccgtgtttgccatctgcgatgatccgtgtctttccaagttttgaacactccacgaggagatgttcgcaagccgcagacaattttagaactttcgtgtgtgccttgtggcacgctaggaagttcgctcattgtctgcagcttgtcggacacctcctgtggattgtcaaaacgtggcaaagacacagaatgagatgaaaaacacggcagaaaagaatttcacgtattttgctccaacgaatgttcacgcccgggttcatccggaacttgagccttcccgtcttttaacagttgcagcttatcacaatgccatcgttccgtgtgacagccacattttttaacccttcacacttccgagggcaacaccctgcacaatgtgtttggagaggatcagatatacaacgataaccgggaatatggagaacgcgatcatgacgtacacctgccccatatcgaacttcagccagtctgccgcacgaagctgcgcgatcaggattgggagggttttcttcttgtcatcgtgtaaaatcaatgccggtgtaaagtaattgttccagctgcttacgaatgtgaagatcgcctgaaccgcaatcgccggtttcatcagcggaagtacgatctgattaaaggtatggaactcgccggagccgtcgatacgcgccgcctcgatgagggacagcggcagagcgctttccatgtactgtttcatgtagaaaaatgtaaccggtgctgcgatcgtcggcacaatcagaggaataaaggaatcctccagatgcatctttccaaccagctgtacgaatccaagtgccgttacctgtgtcgggatcatcatgatcatcaggatgaacggatagatgaactttttcagtccgaaatcatatgcatgaatcgcgtaagccgtcatggttgaaaagtagaccgaaaccagtgcgcttaagcctgctacgataatactgtttaacataccgttccataccggaagtgttcccgcgagcagattcttccagttctccagaagatgcgagctcggtgccagtgtgaatccggactgcagctgtccgtttgatctcgttgcattcacaaacaggatgtagaaccagaacagacagaaaaacgaaataatcgtcaataccacatatgcaatggctcttcttgtatgaatattcattcctttatgtacttctcttgtttccatacagctcacccctttctcttgtcattgccggtaatcttaaatactacaagacttaatacaccggtgatgaagaacaatacaactgacaacgcacccgccataccatagttcttactgtacagatgcttattcaagaacataatcagcgtcatggaggaacgcatcggatctccggttccgtttgtcaaaatctgcggcacatcgaacagctggagaccaccgatcaaggaagttacaagtacatatacaaggatcgggcgcagcagcggcagtgtaatcttgaaaaatacctgcatggaagtcgccccgtctacctcggcagcctcaaagagggaggtatcaattcccatcattcctgccatgagaaggattgtcgtattgccgaaccacatcaggcaattcatgaatgcaaccagtcctcttgtgcttccaacattggaaaggaatttgtaaggtgtatcgataaagccaatctgcatgagcagtgagttgataggaccgctgtcagaaaacaatgtgaagaacaacatggcaaatgcagatgccataatcaggttcggcagatacatcactgtcttaaagaaccgctgtccttttaatttcaggctcacatccgagaaccatgcgcccaaaagcagtgacaggaagatctgcggaataaaacacataatccacatcaccatggtattcttggcataaacccagatgtcaccgtctgaaaacagctttttatagtttgcaagtccgacaaaattcggtccgatctgtgtcaggcccgacagataattctcaaagaaactgttgtaaatggttgttaccatcggaatcaactgaaaaatcacatacacgataataaatggaagtaaaaagatatagccccatttattataccgaacggcttttgacttctttttcatagcatttgcccccttcttttataattgccggatacgcgttccggctggtcttccgctcccggagatccatcggaacccctatcctttgtatacagagctcacagcagcccttcctttttttgcagacctgctgtcagctctgcatttctacacagattacctgtattttgacatagaatgagccacacccgccttcctgatggccggcaggcgtggctcctgtcattctatccttcgcatctttttctggcatccatcgatgcgtcagctagtgatgctcattctctcagttgctgagattacagttccacgattagtgtgtcagttccggatatttctcctctactgccttgtagaacagatccagtgcctcatccttcgttgcgttgccctcgaagtagttcttcattgcgttctggaactcctcgttgcagccctggtcatatgcggaaaggttgcttaagtcaagaccgtcaacacctgcgcagtacatagctaacggattctgtccgcctaataccttgctggagtagctggtgtcttctgccatagcttccattgtggtcttgttgtttacaaagtcatcatctgcaacaacgatatccttcatgatatcagcgttggttgtcatctgaagcatgatatcttttacaaggcttgggttatctgttccgtttgctgcacagatccatgtaccaccccagaagaatccctgcggtccctgtgttgcgccccatccgccgaggtttgcgatactgccttcgtcctcagctgccatggagaagtttactaaccaggccggtccaaagtagcagaatacctttccttccggatagaagcctttcttccagtcatcgctccaaagctctgctgtgctggtctcgcctgcatctacaagctccttggaatcgtcaacccatttcatgatgttgtcatcgatcgtgatcttgccgtctgtaacccacttggaagatacgttgttagagtatacacggtaagaatcgtttgcggaagatgtgatcttgtaaccggcatcttttaattttgctgctgtgtcattgaaagtatcccagtcttttacatattcctgtacatctgcaggatcatcagatccgagaacttcctttgctgcttcgcggttgtagaataatacgcccgggcagccctgccacgatacaccctttaatacgccgttggaatcggtaacgatatccttggtgtactgatactgatctgccagatctgcatctgtgatgccgagatccttcacagccatcgtgtaatcggtatctacatatttcaatgcgtaatcagcctctacaaggaacagatcgatcttgtcatcagctgctgcatctgcctgctttaataaggtagcatccaggttattctggtatgcgttgtcatcgttcggtgtgatgttccattttacggttacatcaccgatggttcctgtggttccgtctacgatggtgtagcccggataatgatcttccagtctggacttaaactcctcattccagcagtagatgttgaggactttgccttcatcggatgctgttgcatctgtagctgcctctgtgcctgcatctgctgcaggtgctgcctctgttgcaggagttgatgctgtgttgtctgttgtcgtcgtgtctgctgtgtcggatgatccacatcctgctgccatggatgctaccatggatgcacataagagtgcgctaatgattttcttcttcatagaaaaccctcctccttaagatgtctggctttcgccattggtttgggaaaccttttcctgcgccccgctgttatttctgcaaaaattttcctacggattgccctggtactaagcttccttctataacgactctctcaacgagagttgttcgcggtttttcaattgtgccaatcaatcgcttggctgcttcgcttccaatcagctctgtgttctgacggattgtggtaagtttgggatgtagcagctgtgagatgcgcgttccatcgtaacctgccacggagatatctctcggaatccgaagtcccatctcaatgatgacattccttccgccgatcagggcggtgtcatccgggtagatgatgcaggtcggcacatcagcgagatttaaaagctctctggtctgccttgctgcttccttcgtctcaagataatcggcagtccggatatattcatccggcacctccagtcccagttcatccatcgtccggtaaaagcttgccagccggtccttggtaacataggaattctcctgaccgtggatatatgcaattttccggtgcccctgctggtaaatatacttcacaaggtcttctatgccctgaatgttgttggagcttaccgccgtacagttatgatgtacatagtcgatcgttactaccggcagatcactgttcatcagttccaggacgtccggatcattgtaatcggcacagacgattgcgactccttcaaagttccggtatctgcagtgttcataataggacatcttgcggttctcaaaacaggtattgataaatgtgatatcgtacccctgcttctctgcctgaactttaagaccgttgagcacgcccgagaaatattcatgggtaagaccgctgcccgcctcttcctcaaagaggactcctatattataggaacggttggtcttgagtgctctcgctgccgcattgggaaaatacccgagtgcttctgctgtcttcttgatccgatgcttcgtctcttcgctgacatccttctggtcgttgagtgccttgcttaccgttgcagtggagacaccgcatttctcagctatcgtttttaatgataccattgcgtcctccacactttcgaaacatcacttaatcgttttcgtacttttactatatgctatcttttgcaaaaatgcaatacatatttgtcatttcggcgagtttaacactttttttgctgattttttgtgcatatttgcttgttctgtttcttttgcttctattataagttgtattttccctatcattcttacacgttttcgctttttatgtctatatttccagttttaacggctttgtatctttcttccatattttgcccgcttttttgttcaatctgccattttccttgcatttaagagtattttaattgatttttttatttttacagtttatacttttaggtagaaattgtttacttaatcgttttcgcaattatttcaatctgaacaattcacttacctattttcgtaacggacgtttcggaaatgcgtatgcttacatgatatgaatggaggtaagcccatgaaattcggctattttgatgatgcgaagaaagaatacgtcatcacgtctccgcggacaccgcttccgtggatcaactatctgggatcaaaggatttcttttccctgatctccaacacctgcggcggatacagtttttataaagacgcaaagctcctgcgtctgaccagataccgctataacaacgtcccgttcgacagcaacggtcattactactatattaaggaaggcgatacaatctggaatcctggatggatgcccacaaagaccgagctggattcctatgagtgccatcacggcatgggatattccaccttccgcagttccaagaatgatctctccgcagagctgaccgcttttgttccggtcgacgacagctgcgagatcaacaagctcacactcaccaacaacggcagcgcgccaaagacgttctccgttttctcctacgtggaattctgcctctggaacgccatggatgacatgacgaacttccagcgtaatttttccaccggtgaggtagaggttcacggttccgcaatttaccacaagacggaataccgcgagcgccgcaatcactacgcgctctatgcggtcaacgctccgatcgcaggttttgacaccgaccgtgattccttcctcggcgcatacggagagaattccgctcccgaggtggttgtcaccggtgcttccaaggattccatggcaagcggctgggctccggtcggctcgcatcacctttccgtgtcgctggcaccgggcgaatctaaaactttcgtgttcgttctcgcctacattgagaaccccatcgaccaaaaatgggtcggacgcccggaggacggcgtgatcaaccgcgcaccggcagaagccctgatggcgcgctacgacaccaccgagaaggcggatgccgcacttgccgcattaaaggaatactgggacaaactgctctcccacttcaccatctcttcctccgaggagaagctcgaccgcatggtgaacgtatggcaccagtatcagtgtatggttaccttcaacatgagccgttccgcttcctattttgagtccggcatcggacgcggcatgggatttcgtgattcctgtcaggatctgctcggtttcgttcatctgatcccggatcgtgccagggagcgcatcctcgacatcgccgcaacacagtttgaggacggaagcgcataccatcagtaccagccgctcaccaagaagggcaactccgacatcggaagcggtttcaacgatgatccgctgtggctgattgcgggtgctgccgcctacatcaaggagaccggcgactacacgatcttagatgagatgacgccatacgacagtgatccttccaaggcaacagacttcatggagcacctgcgccgctccttccactacacgatggagcacctcggtccgcacggtctgccgttaatcggccgcgctgactggaatgactgtctgaatctgaactgcttctccaccgaaccgggagaatcgttccagacgttcggtccgtccgaaggtccgaatgccgagtccgtctttatcgccggcatgttcgtgcgctacggaaaagactatgcggcaatctgccgtcacagaggcatggatgacgaggcagcggttgcagagaaagcgatcgccgatatggagaaaacggttcttgacgccggctgggacggtgaatggttcctgcgcgcctatgaccactacaagaacaaagtcggttccaaggagtgtgaagaaggcaagattttcatcgagccacagggcttctgcgtcatggcggagatcggtctcaaggagggcaactgcttaaaggcaatgcagtctgtcgagaagtatctcgacaccaagtatggcattgtcctgctgcagccggcttaccacagatatcacgtagaacttggcgagatttcttcctatccgccgggatacaaggaaaatgcaggtatcttctgccacaacaatccgtggatctcaatcgctgagacggtcgtcggacgcggcagccgtgcatggcaggtatacaccagaacctgtcccgcctacatcgaggacatcagcgaaatccaccgcaccgagccgtatgtctactcacagatgatcgcgggcaaggatgccaggaatttcggggaggccaagaacagctggctgaccggaacagctgcatggacattccttgacgtctcccagtatattctgggtatccgcccggattatgacggactggtgatcgatccgtgtattccgtcctctctcgacgactttaccgccagaagagatttccgcggtacgacttaccatgtgactgtcaagaacccgaaccatgtggagaagggcgtcatttccatgaccgtcgacggcaaggatgtcgatgtatccggcatctccggcggcatgattccgatcgcactcgcggacggaaagaaagacgtgaatgtcgaggttgtaatgggataacccgctgaggcttttgtcacaaagaattgtcgcaataaacatagaccgctttgggagtgataagtaatattataagaaacacacttgcggatttcgtgtggaaatgcagatggaatattcgttagagaaaaatgtgagtatttcttccggtcgaatgtttgcatcagattccgtgtctcttccacgtttggacaatccgacgggtgcatgtccgacacaccggagacaatgggcggactttctggtgtccctaatggcacctcttcacagacaatataaaaccgcgcgaaccgaactcgccggcatctgctattgaaaatagggcagatgccgactcagacagcggcttcgcgcggttatgttttgttcagaggtgcccataagggacacacacaaaagtcctacaaattgtcttccgggatgcggacatgacccgcggagtgctccaaacttggaaagacacggatcatcgaagatgcaaacatccggctggttagaaatgccacattttttgatccgaatttccacctgcatttccatctgaaatcccacggtgtgatcttataatattacttatcacacaaaagtgactatgcttattgtgacagttcctttaaaaaaagcctcatgcggtcttcccatggaagaaccgcgtgaggctttttcacatattcgctatcgcttagatcgctgtcacaactccgttttcgctgtcaagctctacataagcgctggactttaatacctccagtgcgttcttcgcgccgatcagtaccggaatatccaggctgagtcctgcaatcgctgcatggcagctgtcgctgtccgcctccacgatgagaccggatgcctgacgcatctgcttcatcatgcagttgttggtatctgcagcaacgatgatgtctccctctttgaagttcgcaagatcttcctcgctgtggcagacgcacaggtttgctgcaatcttcttacctgcaattccttttccttttaccaggatatgtcctgccacctgcaccttgatgaggttggtcgttccggatacgccaagcggtacgccggcagtcagaacaaccacatcgcccttgctgatcagacctgccgtctctgcagtgtcaaccgcatagtcaaacagttcttccgccttattcttctgctcaagaagcagcggtgcaacgccccaggaaagtccgagctgacggtatactttctccgtcaggcacgcgccgatgatcggagagtacgggcggtacttggagatcatgcgcgctgtgcgtccggacttggatactgccagaatcgccgccgcattgaggtctcccgccatcgtacaggttgcatgggaaatcgcgttcgtcacatccgggctgctcatattcttacggtccttgaaacgctgcagatagttgatatcgcactcggtgcgaaccgcaatgcggaccatcgtcttcaatgcctcgatcggatactggccggcagccgtctcaccggaaagcatgatcgcacttgttccgtcatagattgcgttggcaacgtctgtcgcctccgcgcgggtcggacgcggatgtttcatcatggaatccaacatctgggtcgccgtgataaccacttttccggcaccgctgactttcttgataatcatcttctgaatgacaggaacgtcctcaagcggaatctctacacccatgtcgccacgggcaaccatgataccgtcggagacgcggatgatctcatcgatgttctgcacaccctgcatgttctcgatcttcgcgatgatatgaatgtcctcgccgcctttttcctcaagaatcttgcggattgcaagcacgtcatccgcgcagcgcacgaaggatgccgcaatgaaatcatagtcgttctccaccgcaaatacaatatcgccgtagtctttctcgctgatgtacggcatggaaagctccacgttcggaacattcacgccctttttattggaaaccataccgccgttcataacggtacagacaatatccatcggcattttgccctctgcatccgcctttgtgcccgatactttctggatcttcttgacttccagaccgatcagtccgtcatcgatcagaatggtatctcccggcttcacatcgtccggcagatccttgtacgtgatcgccacacggctctcatcgcccacgatatcctccgtcgtcagagtaaatgtctgtccgttcttcagctccaccttgccgcttgcgaactctttcagacggatctccggcccctttgtatccagtagagccgccaccggacgcttcatttcctctcgcagcttgcgaagcatcgtaagtcttccaaactgctcctcgtgtcctccatgtgaaaagttaaagcgcgccacattcatgccttcctcgatcaggctgcgcatcacattctcatcatccgtcgacggtcctaacgtacatacaatttttgtctttcttaacataatattcctctctttattctgtcactttattttgtaatcatggtgcccatgcccggagttacctggcttccatccacatgaagctttgtaatcaatacggagcggatcgccgaatcaccgataaagtcgatcgcagcctgaatcttcggctgcatatccccttcgccgaactgtccctgctccatatatttctttgcttccgccactgtcatggaattcagcgggcgttcattctctgtgccgtaatctaggcacacattgtctacgcttgtcaagatcacgagcatatctgcctccagaagctctgcgagctttccggctgccaggtccttctcgatcactgcacttgctccctttaagttattgtcctgggaaagaaccggtataccgcctcctccgcaggcaacaacgatctgatccgcatctgtcagtgcgcggatcgcatccatctccacaatatcgaccggcttcggcgctgccacgatacggcggtagccgtctgccaccttcgtcacatggttgccttttttctcctctgcctctgcctcttcctccgtcatcacacggccgatgatcttgctcggcttgtaaaatgcctcatcgtacgggtcaaccaccacctgtgtcaggatcgtggataccgtcttgtagatacctctgttcagaagctctgcacgaatcgcattctgcagatcatatccgatatatccctggctcatcgccgagcagacagacatcggcgtcgccgtatattccggatacagacggcagaactcattcatcgccgtgtgaatcatgccgacctgcgggccgttgctgtgcgtgatgaccacctgatagtcctcgcggataaaatcagcgaccgcttttgccgtgcgcttcgtagcttccttctgctccggcagtgtcgttcccagtgcgtcatgtcccagtgcgataacgatcttctttttcttcatttttatcatcctccaacgcttttatgcgcgcatttgtaatcccttttccctgtatacaccaaaaaattttaccagttttattttatcacgaaccctctgtcatgcgcaatgggcaacttgtcacggaagcgttaaagtttgccgcaccagaacgcaaaaagcgggaaccgcacacacgtttttcgtatgtgcgattcccgccctgtgttttctaatctcccgtttttccggccggaatttaccggcttcgtcttgcccaaacttctgcccggctcctattcgtcctgcggcaggacaagcgaatcgatcagttcccagatctcctctctaccctgcttggtctccgccgaaaacggtatgatcatcgttcccggctgcacgccgagtccctcccggattgccttgacatttttctgaatctggcttcgcttgatcttgtccagcttcgttgcaatgatgatcggggcaaatccctgatacaccatccactcgtacatcatccggtcgttggcagacggatcatgccggatatcgatcaggagaaagaccgccttcagacgcttggaggtgtgaagatagttctcgatcattttcccccactttgccttcacttcctcggacgccttggcatagccataacccggaagatccaccagatacatggcgtcattgatgttgtagaaattgatcgtctgcgtcttgcccggctgtgcggaggtacgcgccagcgccttccggttcatcagcgcattgatcaatgatgatttcccgacgtttgactttcccgcaaatgccacttcgttgtaggccgtatccggtatcttgctcgtaattccgcagacaatttcaagatttacatttttgatgaccatgttctactccttcttttcgcaaaaagcgacgcgaagcacctgctccatcgtctctacatagacgatctccagtccctttttgatctcacctgatatttcctcgacatccttctcgttcttcttcggcacacagaccgtacggacgccggcgtttttggctgcgagcagcttttccttcaagccgccgatcggcagcaccctgccgcggagcgtaatctctcccgtcatcgcaacatccgcccgcaccggtgtcccggtaattgccgagagcatcgccgtcgccatcgtaatgccggcagacggtccatccttcggaaccgcaccttccgggatgtggatgtgaatatcatttttctggaaaaattccgccggaatgtcatactgtccgccgaccgaccggatatagctgattcctgtctgtgccgactctttcatgacatcgcccagctgaccggtcagctggaattcccccttgcccggcatcacgttgacctcgatctccagcgtatctccgcccacgctcgtccatgcaagtccgcgcacgatcccgacctcatcggtctcaccgcgcatatcctggctgtatttttccttgccgagatacttctcaagattgcgcaccgtcacatcgaccgtgctgctttttccttcgtagatctcgcgcgccgccttgcgcgcaatctccccgatcctgcgctctaacccgcggactcccgcctctctggtataaccgcttatgatcttcgcgagggctccgtcgctgactttgaactgatcttcctttaagccgttgcgctccgtctgctttgccagcagatgttctctcgcaatgtgaagcttttcgttctccgtgtagctagttacctcaatgagctccatacgatccaatagcggtctcggaatcccctgcatggagttcgccgtcgcaataaaaagcacctccgaaaggtcgatcgggagctccacatagtgatcccggaacttatgattctgttccgaatccagcacctcaagcagcgccgaggcagtgtctcccttatagtcactgctcatcttgtcgatctcgtccagaagcatcagcggattcttcacaccggcgctgcgcagaccgttcacaaggcgtcctggcatggctccgacgtaagtcttccggtgtccccggatctccgcctcatcgcgcacaccgccgaggcagatccgcacgtatttcttatccagcgcacgtgccacagagcgcgcaatgcttgtcttgccggttcccggaggtcccaccagacagatgatcgggctttctcccttgctcgtcagattgcgtaccgcgagaaactccaacatacgctccttgactttctccagaccgtagtgatcttcctccagaatccgctctgcgtttgcaaggtctttgttgtcctcggacgctttattccacggaagctccagcagcgtctcgatataaccgcgggtcaccgcgctctccgatgaattcgcgctgatgctcttgaagcggtcaatctccttcttgatgcggtttttcacttcctggtcggcatccagcgcatccagtgctttctggtactcgtccgcatccgattccgtattgtcctcgccgagttcctcccggatgagcttcatctgctcgcgcagtatgtattccttctggttcttatccacgcgctctttgactttgctctggaattcattctggatggcagtgatttcaatctcttttaaaaggagcgccatcaatacctcatagcgctccgtaagtgtcattgcctccagaatcttctgcttttcttcgtaagaaaccggcagattgttcgcaacctgatccatcagcttcggcagatcctgtatggtaccgatctggcgcagcaattcttttccggcacgcggatttactgtctgataccggctgtatgtctcctgtacactgcgcaccatcgcagctttggtctcttccgaaagcccctcctccggcagcacgcacggcaccacctctgccagaagatacggatccgtctgtgcaaaagccgaaagttcggctcgctcgataccctcaaccagaattcttacgatattgttttgtaatttgattacctgctttacttcagcgatcacaccgatatggtatacatcgtccgctcccggttcttcctgttcgacattcttctgcgccgacaggaaaatcttctgggaatccatcatgcactgttcgatcgcacggatggaccggtcacggctgatgtcaaaatgcgcaatcattcccggaagaatgaccatcccgcgaagcgcaaccgcaggtatttttaagatttctgtatccaacatatcctctatttttcttctatggtctttaatttctgctcctcaatggaaagcttctcctccaccagatccttggtgatctcacactcggtgatgctctcatccgacggaatatggtacatcagatccagcgtcacagcctccataatcgcgcgcagtcctctcgctcccgtcttgcgctcgagcgccttgtcagcgatcgcctccagtgcgtccgcgtcaaatgcaagcttcacgccatccagctcaaacagcttctcgtactgtctggtcagcgcattcttcggctcttttaagatgcggatcagggcgtcgcggtctaacatatccaaagataccgtcaccggcacacggcctatgaactccgggatcagaccgaacttcacaaaatcctgcggcagcgcatgcttcaacacatcgccgatattgtactcattctttgacttgatgtccgcgttgaaaccgattgccttctgatccatacgcgtctcaatgatcttctcaagtccgtcaaatgctcctccgcagatgaacagaatgttcgtcgtatcgatctggatcagttcctgttgcggatgctttctgcctccctgcggcggtaccgatgcaatcgttccctcaaggatcttaagcagcgcctgctgtacaccctcgccggatacatctctcgtgatagacacgttctcggacttcttggagatcttatcgatctcatcgatatagatgataccgtgctgggcacgctcaatgttgtaatctgccgcctgaataatcttcaagaggatattctctacatcctcaccgacataacctgcctctgtcaacgtcgtggcatctgcaatcgcaaacggcacatttaagacacgcgccagcgtctgcgccagcagcgtcttaccggaaccggtcgggccaagcatcaggatgttgctcttctgcagttccacgcccagatcgtcccctgccataattctcttgtaatggttatatactgcaacggaaagaacctttttcgcctgatcctgtccgatcacataatcgtccagaaaggcttttaattcttccggttttaaaaggttgatctgctccgtctcttctgcggtgccggtctcttcctcgttctcaaactcttcctcaataatctctgcacagatgtccacacactcatcacagatatatgcccctttcggtcctgcgatcagcttgcgcacctgtccctgagattttccgcaaaaggagcagcggatctcatcatcacttcttcctgccatttttaactattctccatgttctatcttacttcctgccaaaatcaggtcttatttgctttcttccttcttggtgtccttgcggatgatgacatcgtcgatcagtccgtacgcctttgcctcctcggcagacatgtagtaatcgcgctcggtatcggcagcaaccacatcgtacggcttgccggtgttggcagcgagaatctcatttaactttttcttggtctttaaaatgttctccgctgcgatctggatctctgtcgcctgtcctttggctccgccggacggctgatggatcatgacctccgcattcggaagcgcatagcgcttgccctttgttcctcccgcgagcaggaatgcacccatgcttgctgcaagtccgatgcagatggtggacacatcacacttgatgtactgcattgtatcgtaaatcgccatacccgctgtcaccataccgcccggggagttgatgtaaagctggatgtccttgttcggatcttcggactccaaaaacagcagctgtgccacaacaaggcttgccgttgtctcattgacttcctctccaaggaaaataatacgatcttttaacaggcgggaataaatatcataattgcgttctccgcggctggtctgctctacgacgtaaggtactaaactcatattcgatcctccattttatacttttttaataattacttataagcttaaacagaccggcccaatagagccagtctgtctgttttgcaataagaactgacaggggaattactcctctgttccctctttctcttctgcttctttttctttcttggattttgctttcgctctctccttcacgttctccatgatcaggtctactgccttggtcactgcaaggtctctcttcatggattccttctcgttgtcgccgatgtactctttgagcttgtcagcttccataccgtactgtgctgccatcttctcaatctcagcatcaagctcttcatcggtgatctcgatcttctcatcctttgcaatctgctctaataccaggctgctcttgatgcgtgtctcagcttccgggcgaacctgctcttttaacttgtcgagtgtcagaccggagaactgcatgtactgctccatggaaagaccgctctgtgccagtctctgagcaaattcattgaccatgttctcacactgtgtctcgatcattgcctccgggatctccatggtggacttgtcaatgatcttctggattgcctcgtcctccttggtcttcttagcctcgttctccttctctacctcaaggtgcttcttaacgtcagccttgtactcctctaaggtatcgaactcggatacatcctgtgcgaactcatcgttcagttccggaagctccttgcactttacttcgtggatcttaaccttgaacattgcaggctttccggcaagatctgctgcctgatacttctcagggaaggttacgtttacttctacttcgtcgccggcattcttgcctacgagctgatcctcgaacgtatcgatgaaggaatgggaaccgatctcaagcggatgattctcacccttgccgccctcaaatgcaacgccatcaacaaatccctcgaagtcgatcactgcggtatcgccgtttgcgatcggtctgtctgtaacggtaacagttcttgcgttgttatttctctctttctctactgctgcctctacctcttcgtcagatacggaggtatcgatcttggttacctgaacaccaagatacttgccaagctttacttccggtcttacagcaacctctgctgtgaagatgaaaggcttgccggactcgatctgtaccacgtcgatggtcggtctggatacgatgtcaataccgctctcctctactgctgcaggatagttctcctggatcagggtgtttgctgcgtcctcatagaacactgcctcgccgtacatcttctcgatcatctttctcggaactttacctttacggaaaccaggcatgctgatcttgcctttttctttcaggtaagcagcctggattgctttctctacttcttcggcagccacttcaatggtaagctttgccatattcttttctaagttttctacctgtacactcattgtaactatcttcctccttaatatatatgaaatatcatgtacatcttccgtccatcgcatgacattcgtcacgccagtcgcctgcagcccttttttaagggttcctgcctgtctttcggaaaaaagggcgtactacgactatcacagtcatttaaggattataacatacaagaccggaaaatactagcttttttttgatttctttgcggtttttccgccaaaaacacgccctagagctccacaccgcgatgttctacagaggtagagaacacaatcagcgtctttgtccgtccaaaatactgtaattccccgataaaacggtcgagttccatcgtattttcaaacaaaacctctaacagcatggaatagtcgccggtcacacagttacactcaatcacgtttttgcacttttttatatagcgaatgatggaggttctgtcaagccgcatccgcttttcgctgcgcggctttcttactctctcacccggcttcgtactgcttttttctcacgggtttttttcacggtacacccttccgcctctctcattcggcttcgtactgcttttttctcacggggttctttttccgctccacgctccgcagctgcttcttccgcgcggtctcttcccgtcgcttcgcatgcgccgcctccgccagaagcttcttatagttaagcagccggcgttccggcagtcttccgtcccgcactgcctcctgcaccgcacaccccgtctctttttcatgtctgcagtctctgaatctgcaatgctgcgccaattcctcaatatccgaaaatgtcgtatccatcccgcattttgcatcccctacgccaagtacgcgcattcccggtgtatctatgacacgggagccatccggcagaaggatcatctgccggtaagtcgtcgtatggcgtcctttggaatcatcctcccggatcgcgccggtatccataaccgtctccccacacagcgcattcacaaacgtggatttgccgacaccggatgatcccagcagcactaccgtttttcccgcacccagatagcgttgcacgtgttccatcccttcgcccgttaccgcacttaccgcacacactgcaactcccggcgcctgcctctccacaagatttacataatattccggttcctcgcagagatcttttttcgtcagtatgacaaccggcgtcgccccgctctcccacgcggctgtcagataacggtccagccggttctggttaaaatcatgattcatcgacatgaccagaaacacatagtcaaagtttgccgccaccgcctggcgctccatgccgggcgtcggattttcccggtaaaacacgctcgttctgggaagcgtctcaaggatcagtgcatccccgcaccggtttgtctgaatacgcacccggtcacccactgtcggaaatgcctccccgcccttgtcctgataatacacaccggtctttaacctggcattaagctttgtatctgacgtttcctgttccacaagaatctcataacgttctctgtgtaccgctgtgatcagtgccgtcgctttcgtattttctgttttatttcctgtatgttccatccgttttcctctttcctctcaattttccattcactgtttctttccattcctacaatctccattctgtttttctccatttttacattcctcctttattaaaaagaatctcgcttgcgagattctccgcacgcgagcggttcgcaaagcgatattttccttaccgcgagctgcgcatcctcgcggagcgttttttatttcataggaaagttccactttcacacatgaatgtatcacggtatttcctatgaaattaaaaagcattcctgccacattcctgcaccgcaatgcttctgccttcattcattctgttttttgtgccggattgccgtttccagattgtaaaaagcaatcgacggcttgcaacacccatttttcaataagcattgccggcttgcaacatccatttttcaacaagcattgccggcttccagtctccgggttttccaacataatcgcagatttataccaggcgcttcaccataaagtgatcgtccgcatagctgccgtcccgataccggacactgtgcggctgcgttccccagatctcaaacccgaggctctcgtacagtcggatggcaggtgtgtttgtgctcaccacttcaagttctgcctgctcatatccgcactgcttcgccaccgtaagcaccgtctttagcatttccctgccgattccgagcccgcagtatttctgatagagggcaatcgcaacactgcagcgatgcgcatagcgctcataatttcccagagacatcagggaacagtttccgacatgttctccagcaacggttccgatcaacatcagttcccgcggttcttttacgattccttctataaaatgttcctcctgctccggtgtaagactgatctcatccggctcacgtatcagaaatggcgtctccccggcagtcactttcagataccggatcagatcatttgcatccgtcactgctgcactgcgcagaatacagcttcgcccgtcccgacaggtaatttctcttggttcataaatcataattgggtctcctccctgtgatctgtatcactccggcactttattttttccacattttcttccgtgatcgtcaaaaagtcgatctgcacggtatcgctgccgccgcaaatcccggcaaaaacaggtttctctgacacgatgcgtcatgatagtcccggcttttccgctttttgtgcatccaccggaatcggtttttcctcttttatgcatccaccggaacatgcttttcctctttttgtgcatccaccggaacatgcttttcctcttttatgcatccaccggaacatgcttttccggtgtcagaccttacctggatgcgtttgcatgtattacgcatcctttagatcgattcctgcttcccgcagatttcttcgcagttccggcatatcctgatgataaacgcatccccgcattcccaggcgtatccccgcttcaatgtttgccggcgagtcgtccacaaaatagctttcctgcggctcaatcttcattttccggaagaaatccacatacgcttcgcgttccggcttcagatatccacactcacacgaaatccagatgccgtccatataccctacagacggaatattttttgaaaatgcccggaaacggtgtgatgtatttgacatcaaaaacaaatggtacccctgttccttcaactctcccagaagcgcctccatcggcggattcggctcctgcttcatccgaaactccctcacgaaacgctccacaagctcccactcactctgcagaattctcttgcaaatggaacgtaccgcttcctcatcggtcattgttcctctgtccatgcaaatccactccaccgatgcacaaacctgatttttcaacaatgctgcctgcgcttcatcctctgtatatgtcccgatgtaatcgctcagcttatattttgtcagaacatttcccatatcaaatacgatatttttcattttatctccatattccgttgacctgctgcgtcacattgttccggcgcatgcgcgtactcttatctttctatgtcgatccggcgcatgcgcgcactcttatctttctatattgatctggcacatgcgcattgcatcaagcgctatctcgtggcttttcggcgttacccctgcacagcaggatgcatccacgataatcggtgtctccggcaaaaatgctttcaataacaatgcatttgagatcacacaaatgtccgtgcagagtccaaccagcgtaatgtcctcgatctgctcttttctattctcctcctgcagcaactcgccaagcttctccgaaccgaatgtcaccttatcaatcgcctccgcctcccggagcgcctctagctgcggacagatctcccagcctttcgtgcccttgatgcagtgcggcaccggaagatgttttccctcctgtgtctctaaataccgctctccatgtgtatcccgcgtgaaaatcacttttcccggaaactcgcggattttctgctccacccgtgggacaatggcgaccgcctccggtgttccaagcgctccattgataaaatcattctgcatgtccaccacaatcaatattttctgcatcttttctcctccttctgaaacttcgcgggtctcacggtctctttttcctctctcagacccgcagggcacctctttttcacgaatttcttctgtttttcgctctccgcgggtctcacgagctcttttttctttcctagacccgttttttctcttttttcgggtctcacggtctctttttcccctctcagacccgcagggcacctctttttcacaaatttcctctgttttttcgctcttcgcgggtctcacgggctctttttcctctctcagacccgcagggtgaacctttctaactcggctgcagaccaggtccacccttccaactcagttgcagaccaagtctaccgttccagcccaaccgcagccgcaacgcctcatcttccaattttttattccagccccgcgaactgcgccatgtaaagatcgtaataagcaccttttttcttcatcagctctgccggacttccctgctctaagatgcagccctggtcgatgacaaaaatgcggtctgcattctggatggtcgaaaggcggtgtgcaatcacgaaactggttctgccggacagcagtgcctcaattcccttttgcacaagaatctcggtgtgtgtatcaatactggacgttgcctcatccagaatcagaatcttcggcatcgagatcatcgtccgcgcaaacgcaatcagctggcgctgtccgatcgaaagtcctgctccatgttccttcaactccgtgtcataccctttttccattttcataatgaactcgtgcgcattgacggccttcgccgcagcgatcatctcctcatccgtagcgtcaagctttccatataaaatattttcacgcacagtgccgtggaaaataaaattgtcctgtgtcatgacacccatctgccgccgcaggctttcgatggaaatcttcgtgagatcgtagccatccaccgaaatgacaccatcctcaatgtcatagaatcgactgatcagattcacgatcgtcgtcttgcccgcgcctgtcggtccgacaagcgcaatcgtctctcccggctccaccacaaaactcacatcggaaagcacctttgtctccgccggcgttcccttatcgtatgtgaagctgacatgggaaaattccactcttccctgtacttccggcagttccgtcacgtccgccgcatccacgatatctgcctttgtatccagaatatcaaaaattcgctccgccgccgttaagtttgtcaccagattattataaaaattactcagattcataattgggttccagaacatattgatgtacgtgccgaatgcaaccagaagtccgactgaaaccttttcaaaaccgagaaagcggacgccgaccagatagagcatcatcgcgccgattccccaacagaaatcaatcaccggtccgaacatatccgcatagcgcaccgcgtccacgaacgactgctgatgctcatctgtcagatttccgaaaatctctcttgtctcctcctcggcgccaaaactctgcaccacattcattcccgcaatgtcctcatgcacataggcattgaggttggatgattttttgcggaaaatctgccagcgcttatgcgaggcagtctgcacaaaccaaatgccgccgatcatcagcggaatcgtgctgagtgatgcaagtgccagacgccagtcctttatcagcatgatcaccacaacaccgatgaccgtgatcagttccggaatcaatgttgtcactacatttaccagaacatcccgcagcgaattcacatcgccgatgattctcgccagaatctttccggtcggtctgctgtcaaaaaaagaaaacgacagcgtctgaatgtgttcgtacagatcctgacggatgcgcagcagaatcttgttcgataccaccgccatcacgtacatacggatcttcaccataatgataaaaataatattcagtcccagcgcaaacagaccgagtcccatcagacctttcatatctttatttgcaatataatggtcgatcgcctcctcaatcagaagcggattgaccagtgaaatggcaaccgtcacagccatgcagagcagcacgccgatcaggattgctttatattccagtaagtaggagaacaaccttcggaaaatcttctttttgtcagtgttctccataaattcatcttcacgataggaattaactgccatgaactctcatccccttttcctctataataaacattttcattcgctgcgcccgctcgggcggcttcgcctccctcgctgtacggcattcgccgcatccctgccgttcgcctgctctcagcagcacgctgctggtgccggctctcctgcagaggcgctgctcattgctaacgcaccatactgtgccatgtaggtgtcgtagtacaagcctttctttgcgagaagctcctcgtgtgtcccgcgctccgcaatctttccgtctgcaagataaataatctcatccgcatgacgcaccgccgagatgcggtgtgcaatgataatctttgtcgtatcgcgcagagcgtttaacgtctgctggatctcatgctccgtctccatatcaagcgccgaggtcgagtcgtcaagcaccagaatcgggccgtgctttgccagcgcgcgcgcaatgctgatccgctgcttctgtccgcccgaaagtccgacaccgcgctccccgatgacagtctcgtactgttcatccatcttctcaatgaacccgcgtgctttggcatcctctgccgcgaggcgcaccgcctccatctgaagttccttgcgctgtcccatcttgatgttctcctcgatcgtatccgagaaaaggaacacatcctgcaaaacaaccgcgatgttgctgcggagctgatgcacatccatatttcgcacatccacaccgtcaatcttcaccgcgccgtccgtcacatcgtaaaaccgctggagcagattgacgatggaggatttgccggaaccggtcgcccccatgataccgagcgtctttcctgccggaacggtaacattgatgtcctgcagaatcttctgcccgtccatgacaaagcccgcgtggtcaaaacagatctctccccggatttcgtcaagcacctttggatgctcgtcgtttttgatcttcggctgctccgcataaatcttgcggatcttcttataagatgccaccgcggacgacacatcgttcgtcagccagcccagcatctccatcggccaggtacagttcctgctgtactccacaaacgccaccagcgcacccagtgtcatctcaccgttcatgacaaaaataccgcccaggatcgtcgaacaaaccggaagcacctttcccacaaacgaaaacagcgggtaatactttgtcagtacctttgcctgtgaaacattcagttcgtaataccggttgttgtgggataaaaatttttcaatctcatgcttttcccttgcaaacgccttgactgtgcgcacgcctgcaagattctcctccgccacagttgtcagcacggcattttcctcactgatgtcctcgtaaatcttgtcgagcttgcgctccatgatgatcgcgaccgtaccgcacaggatcattgtggcaagcggcacgaacgccagcttccagttgagcgaaaacatgcagtacagtaccatggacacatgaatgataacctcgatgacaagcatgcccacatagcccatcgcattccagattttatccacgtcatccttgacacgcgccatcagttctcccgtgttcgtgtcctcaaaatatcccatggacagcgactggatatggtcgaacagatccttgcgcattgccgatccgatcttggatgccagcacgtcgaacgtgaactccttgcagtagccgaaaatactcctgccgattcccacgatcacgattccaaccagaagtttcgtcaaaagctccagttttccgcctatgatgacatcatccacaatctgctgtgtgatcttcggatacagcatatccagaacgatcgccgtcaccatcgaaaataccgcaaacagatacccataccaatagcgtccgatataggtgtataactttttcattccctaatctcctccttcttgtcagttccccggtgtcaccttcctgcaaaacaaaaaagcgagggggcatcccgttacggattctcctcgctttttgcgtaaaaaaatccgtggcatctttcgatcaccacggtctatcatcaggaatggtattgtcacattttcacgccatccgcatcttctcatacggcatgtgcattacttctgaccgttactccccaccgaggcaatcatatgattctgctttttcacttccacgacgttacttgtaattctactcataatgcttacctctctttccttaaaatttagattacatgttgtcttacaaaaaccagtatacgcatacctctttttaaatgtcaagaaaattctcataatttaccattataatatttgatttcgtgcaaataataggattaggaattacagtaattcattattgtactcctaaatcacaccggaagatgttccgggaaaacagacgacaatatggagggaaaaaccatgagtggatctagcaattctaattccggcacaaaccagatggcagtgccgcaggcaaaagaggcaatgaaccgttttaagcaggaagttgcaagtgagatcggtgtaccgttaaaggacggctacaacggcgacttgacttccgcacaggccggaagcatcggcggcgagatggtcaagaaaatgatcatgaagcaggaagagcagatgtccggcaaataaaccggcttcttctgcccattgcaccaaaaacggggctgtcgctttaagcaggcagtcccgtttggcatgagaagaaataggacaagagaatcatgcccttcgatttcagatggaatgcagatggaatattttttgtgaaaaaatgagagcatttctttctgccggatatttgcatcggattccgtgtctcttccacgtttggacaatccgacggggacatgtccggcacaccaaagacaatgggcggactttctagccgccctaactgtactccctcatagacaatataaaaccgcgcgaaccgaaactcgttgccatctgctattaaaaacaaggcagatgacaattcagacatcggcttcgcgcggttatgttttattgcgacataaggatggctgatttatgccatccggtgtttggtactggtaagggcggcacaaaagtcctacaaattgtcttcggggtgcggacatgacccgtggagtgttccaaacttggaaagacacggatcatcgcggatgcaaatatccggctggttagaaatgccgcatttttgaacagaatttccatctgcatttccatctgaaatcgtgaggcatgatcttcttgtcctattacttatcattccattacgtgtcacgccaaaaggggactgcccgtttcacgcggcagccccttttttgtgctcttttatttttcgtgcatccagacgcgcatctggtttaaaccgcggtttccccatgcaaaataagggattgcgcgaagcgtaaccgtttcttccttcggcggttcctcggtgtagagttcctccgacggcacaagccggatccccgccacatcgagcagtgtgagaccggaaagcctgccttccgtgcatacgagagcctttgcatccagttctttttttaccgcaagcgcctgcagattggctccgttgtcagcgccctcaaagcagtagaccacaggtccgcgcatcagcgccacgcatccgacgtcctcgcgtacatgcgtactcgcataaattttgcgcaccggcagtggaaaatgaagttccacctgatcgtcgcttccccattttctgctgatgtacaaatagccatcacggatttctccggcagtatcaaacgcctccccgttgaccgtcacgcgcaggtctttcacataagccgggatatgaatggcaagtgtaaagagttcgtcgatcttcgcggacacatggtaagtcacgcttccctcccacgggtatgcgctctccacgcggatgtccgccttgccgagcgccgcctcctgtcccagaaacagatgggaatacaccgccgtctcgtcctcatcccacgcatattttccaagggaggtcaccatgcggaccaggttcggcgggcagcatgcgcacgcataccagcccggacgctccggaatcacatgtttgtaaccgaaaatctcgccggacacacccggattgacctccagcggattgacgtagaaaaaccgctttccgtcgagctgcataccgctgatgatgccattgtagagcgcccgctccatcacatcggcatatcttccgttcttctccgtctttaacatatttctcgcaaaaaagaccagaccgatcgacgcacaggtctccgcatagttcatatcgttcggcagttcatactcttttgtgaatgcctcgccctccacggtcgagccgatgcctccggtgatgaacatctttttctgcgtcatattctcccagagccgtctgcacgctgcaaacaacttctcatcgtgatcctccgccgcaagatctgccatcgccgtgtacatatatacggcgcgcacactgtgtcccacagcctcatcctgctcgtagattgtcgcatggctctggttgtactttgtgtcgtccgggatcatattgccaaaatgcgtccagcccctgcgctcggtctcctccttaaagaagttcggattctttccacgctcctcgaggaaatagcgcgccatgtccttgtaggcttcctttccggtcgcatggtacatgcgcatcagaccgatctccacctcctggtgtcccggaatgcccggaatcttatcctctccgaaccggttcatgatatgctgcgccatccgctccatcacgccgagcagcttgtcttttccggtcgcctcgtaatacgccactgccgcctccatcatatggcctgcgcagtagagttcatggcactctaacagattctgccagcggtgctccggctccttgatcgtgaaaaatgtattcagataaccgtccggctgctgtgcctttgcgataatgtcaatgatgtcgtccgcgcgctgttccaacgccgcatccggcttgatcacgagcgagtacgccacaccttccagccattttgccacatcgctgtcctggaataccatcccgtagaactcaccttccatcagtcctgccgcaatgcggaaattatccagcgcatggctcttctccacgccttcttctttatcgtttaataccctctcctgaaacggtatcacagtatctgtgatcttttcctgcataccgctccagaacgggtctttgatccgaatttgctgtaatgcaatctctttgctcatctcttttcccccatcagttccgatattcacgggtcatttccaattctctggcgagatcctccggcgtcctgtacttgcggaataccttctcgagcacatagtttttcaccagtgcaaacactcccggaaacagtacaatcaggcactgtgtatcgttgcacatcagaacaaacagcacaaacacagctactaaaagcgccgaccatcccagatttgccaccaccatcacaagcgtcttcttcatggactcccgtatggttccctcaaacctcgccatatacgccgtcaggtaaaactcccacgccagcgccatggcagaaagtacaataaaaaaataatacagcgcaccaagcgccgagccctgtgccagaaactgtctggtcaccacaaggtccgccgcaagaaacgctgccagtattccccacagcagccatgctcctgtggtctgtttcaaatccgttttcagagccgtgcaatattcccggaatgcatagccctgtccatgtacaatgcttttattgaccgcatggtacaccgccgctgtggcggctcccatggtaacgaccggaatgctgcatacaatccacagcgcgccgagaatcaggcagtccgccagtcctcccagtatgcggaaaacgttgttgttgtaatcaaaaaactgattcatatgccctccattccggtctaagccattcggttattttttcagacggatgcttaccacgctgcatgccggaatctgtacccgtatgccgtccgccgtcttctcgtaatctgcaaatgcctgctccgtcaccacttccggtgcctcaaacgtgttgtgtgcattcatcgttcctgccacaacactcgcctcgcatacgccgtatgcagcgccgtcgtccgtcagctggatggtcacattctccgcagcttccagtgaattgttggtcagtgtcaccgtgatcacgccgtccgcgttctccgatacagactcaatcaccttcggcagttcgttcttgcctgctcctacggttccagcaccgatcagatcgcttctgagaagagttgctccctgatgatgacgatacatatggaatacatgataggtcggtgtcttgatcatcttctcgccgtcggtcagcatgacagactggagtacattgatgagctgtgcgatgcatgccatcttcacacggtcggaatgtttgttgaagatgttgagtgtcatacctgccacaagtgcatcacgcatggtgttctgctgatacaaaaatcccgggttggttcccggctctacgtccgtccagattccccactcgtcaacgatcagaccgatcttcttgtccggatcgtactcatccataatcgcaccgtggcggttgatgagttcgtccatgaaataacctctctttaaggtctggtagaaaatctcctccgtgaagtctgttgcgcttcccttcttattccagtcatcctccacctcaggaagtgtataataatgaagggaaagaccatccatcattccatggaaacgcggctcgcagtgatcaaagcaggtctccatcacctttttcgtccactcgtaatcatccacgttcggtccgcagcagatctttgcgatcgggtcatttccagcatagtttctcacatatgtctggtatctgcggtactcatctgcataatgctgcgggcgcatatttccgccgcatccccagttctcattgccgacaccgaagtaatcgatcttccacggctcctcatgaccgttctgcttgcgcaggtctgccatcggggatacgccgttgaacgtaatgtactctacccactcgctcatctcacgaaccgtaccgcttccgaggttgccgttgacataggtcttgcaaccaagctgacggcacagttcaaagaactcgtgtgttccgaagctgttgtcctcgacaacgccgccccagtgtgtattgatcattttctttctggatgctttcggtccgataccgtccatccagtgatattcgtctgcaaagcatccgcccggccagcgcagcaccggaatcttcatttcttttaatgcttccaccacatcggtgcgcattccgttgacattcgggatatcggaatcctctccgacataaagtccctcataaatacatcttcccagatgctccgagaaatgtccatagatttccggagcaatcgtgctcattttcttgtcgttattgatgactaattttgccatagtaacctcccgttatgtatcagtccctttcgagtttttgctgtcattgattcacatcagccctttacagctccggctgtcattccttcgatgatgtacttctggaagatcaggaaaatcaccaggatcggcaggattccgaacatggaaccggcgatcagcacatcatagttgtttccgtacggcgtcagcaatgtatttaatccgatcggaagggtgaacttttctgctcccttcagtaccagaagcggccacaggatcgcattccagcttcccattgcctgcagaattcccatggaggcgaatgccggcttcgtcagcggaagaatgatttttgtcgcaataccgtactctgtcgcaccgtcaatacgcgccgcatccagaagttctctcggaagtcccgacagatactgccggaagaagaaaatcgtcgatgcgttacatagtccgatgataattactccggtgtaggtatcgatcagatgcagtgcaataatttccttatataaaggaagcatcagaatctcaaacggtaccatcattgtcgcaattacaaggaagaagaggaaattcttcagcttgaaattgtacattgtcagtccatatgccacaaagtagcagatgaacaatgtcagaacgaccgacacgatcgtaataaccagagagttcttataccacataaaatatttctgactgtccgcatttccggaaaacaggtacttatagttatccagattcatcgtacggatatcgagatcgatcgacaatccacggcggatcagctctgttcctggtctgaaagaggcaagcagacctgcgaataccgggaagataataatcaggcttaagactgcgaaaaatcctgtgccgagaactgttcccactgtccgttttgtcttgccgctcttcgggcccttatcgccctttctgttcttctcatctgccatgttatttctcctcattcttaaatgttccatttgcaatcaactgaacgatattgatagcaagtgcgatcactaacagcaccacgccgaccgcgcatgcataacccatatcatttttctcgattccacgcttatacaggtatccaacgatggtgagtccgatgttgttcggtgagttgttgcccgcccataacatgtaggattccaggaacattgccagtccggcatagatggaaatcgtgagcacgtagaccgtcgtcggcttcaaaagaggaagcgtcacatagcggaacttctgccatgcagatgcaccgtcaatctcagatgcctcatagagggaggagtcgatcgccttcagtcctgaaaggaagtagagcatattaacacccgtccatctccaacatgcgactaccagaagagccgtcatacctgaccatcccattttcagccatttataggtgccaaggcccagtgctgcggtaataatattcatctgtcctgtcgaatattccgtgaacatcagtcgaaataatgtaccggaaataaccacggaggtcaatgccggcatatagagaattgccttccacacaccttttgcttttaccagacggctgtccatcagcactgcaaaaagcatcgggaaaggaatcaaaagcaccaacgtaaacagcatgtattttgtactgttccagattgccgtgtggaatacattatccttcaacaacttctggtaattggcaagacccacccactctgatttgattgctccgatgtcctgaaaactcattgtcacggatgtgatcaacggatagatccagaaaaacgcaaagcttaaaataaaaggtatgacaaaaatatatggcgctactttttccgaatacaagaacttttttaacttcaactcaacaccctctccttcttatgaaaacagggatgccagaggagaaccctccagacatccccattcccaaaacttatgtcctactgctcaagatcgactgcatcctgtaactcctggagagcatcagatacatccatgccgtcctcaagtacctcatttaatgttgtgttgcatacatactcgttgattgtcgggctgatcgctacaacagagatcttaccgatgttgtccataccgatggaattcaatacatcgtacggatagtttctgaagtatgcgttgtactggttgctgtcgtcatgtgcgaaagcatcatctgtccagcatgcggtgttgcatacgtcgaatcctaatgtatcccagatgttcttctcaccctcgtcagacatctttgcccagcaaaggaactcagctgcaagatctgcgctcgcagactgctgtgtcacaacggtacctgtaccaccgataccaacggagcacttctgacctgcctcaaataccgggcacttagcaatgtaccagttaccgctctcctcaggcatatagtttgtgaaacggctcatgtaccataatgccttcgggaaagatacgatgttgtgatccagaatgttctggaaaccagcctcaaggtctacatgtccatccggagaaacctctgcgaagccgctgtctaaccaggactgctgcatctctaacattttctgaacggaatcaagctgaacgtttgccggatcatcgaatccgccggtccagtcatcgccgtactcagccattgccagccataaccagtctgtaccgcctgtatctacggatgtgaagtatttgccttcctcaccgattgctgccacatactcatcaccgagtgcctgataatcatcccatgtaacaacggaatcaatcttagcagttacctcatcctcagaaattcccatagcctctgccatagctgccacgttatagtacattacggttgcacctacatggtacggagctccataataatgtccgtcctcccctgcgtaggtatccatacgtgctttaaccatagtctccatgtacggagctgcgtagtcatccagcggaaccagccactggtcaagacctgcaaccacgttcgggaactgtccaacctctacatcacagatgtccggtgcaccggttcctgcctgaagtgcggtaagaagctttgtgtgcatatcgctgtacggatatgtcgtacatgtgatctcgatcgtctgatccggatgctcctcgttccaaacctcagccatcttgccgtaatgctgtccgtgaagctctacgaatgtccacatctcaagatgtgttccgttcggatcaccgaatgtgttggtaacaacctctgactctgcggattctgttgcatcctctacagcgtcctctgctgctgcctctgtgccatcccctgttgtgcttcctgaatttgaagcagtggtagaagcatcagagcttccacatcctgcaaacagggatgtgaccattgctgcgcacatcagtgcactgaatactttccttctcatataattcttgccctcctccttgaattataggataataaaataagttgctaagatgatctgaaattcacataagatcttgtcataagctgggctcattagctatttcgacaatttctttgttcgatttcatttatcttatgtagataatatacaatgcatttcctgtggtgtcaatatttattttatatttttccaaagtatttttgcttttcgctaaattatacaaaattatgaccgacatgtcatgtgatagcgttcttgttttgtgcaacttgacatattgttttgtttttatttaaatatttttaatttcatccttaatagttgacacttttctataacaattctataataggaaactaataaagaacaccttaactagttccgtttttacaggaggatactcaggaaatgattcatattacttccttagacgatggtctggagacatttaaggctctcgggtctgacacacgtatccagattcttaatattttacttgaaaacgagcagatgagcatgaaccagcttgcgacagagctaaacatcagcaacggagctctcacaggtcacgtcaagaagctcgaagagtgcggtctgatcaatatctccaatgaatctgccggacacggcaatcagaaaatgtgttccgtgacgcaggaccgcatcattgtggacatcaagaaaccgattgattataagaatgtattcgagactgagatcaaggtcggacagttttccagacatcaggtgtggccgacctgcggcatcgccaccagcgaatccgtgatcggcgagttcgacgatatccggtactttaatcatccggatcgttttaccgccaacattctctggttcactaagggctatgtcgagtataccataccgaacctgatcccctccaaccagcggatcacgcagctttccatctcggcagagctgagttcggaggctcccggcatcgacaacaactggccgtcggatatcagtttttacatcaacgacaccaaaatcggcatgtggacgtcccctggtgacttcggcgatgtgcacggtatgttcaccccgcagtggtggccgcagaactggaatcagtacggtctgttaaagctgttagtcatcaatgattacggcacctacatcgacggtcttaagatctccgatgtcagcacgctctcgcttcacctggactacaacagcgacatccgcctgcgtctcgcggtcgagaatgactccgagcatgtcggcggcatcacgctctatgggaaatctttcggaaactacgatcaggacatccgtgtcgccatcaattatgcgccgcttgtcgctgcgcagccgtagcgggggatttcttccgggcagttgtatagatagacattagctctgaaacggttgtgggtgcagctgcgggaggtattctgatcgcaaaatccggtatttctaaccataccgcgtccggcatccttgatgatctgtgtctttccaagctttgaacactccgcaggatgtgtccgcaagccggcagacaattttaggacttttgtgtggcgcttattgccactgatgaacaaaacataaccgcgcgaagccgatgtttgaattggcatctgccttattttcaatagcagatgccaacgagtttcggttcgcgcggttttatattgtttgtgaagaagtggcattagcgccactaaaaagtccgctcattgtctgcgggttgccggacacacctgtggattgtcaaagcgtggcaaagacacggaatttgatgccggacgcggcacggaagaaatactcgcattttgctttaaagaatacctcacgcagctgcatccgcagcctctttcgttcttttgttctccatacaactgtccgggatcatgtctctcccactacggctgtgcgtcgactaccgcttcttcgggctgcggatacagctgcggcactaccacttcttcttcgggcaccgtgacacggctgccactgcgcgcagctccacatagcagccgcacgccatgcaggttccggcattcagcttcccgcattcccggcagaccgagagtctgctctcatagacttcctctgtgacccggtccgcctctttgatcgcagcgcggtatttttcaatcatttccatactgtcccccgcctcgatcatatcccgaagcagacagcgcgtacacactctcttctccatcatctcatgcccacatttctgaatttttaccggcaatcctactcgtcgaacccgaacaccggtcggccgtcctgccatctgatcttcataagcattgcgtgacggttcggattgtacagcgggttgcccacaatctccgtctccgttctcgcatggtagaccataatgtcatctcctgcctcatccttcgtgaaggaattatgtcccgggccgtagattcccgctttttcactggatgtaagtaccggatagcgctcttttttccaggagagcggatctaacagatctgcgtctgcatccgccgtcatcatacccatgcagtaatgcacgccggtatcgctggcggaatacgtcataaatactttgccgtccttctgaatgaccgccggtccctcatttacccagaagccgtggcgctcccagtcgtaatccggcgttgtcagaagaacctgcacggaatccagcgtgtagccgttcttcattctggcgatgtaaagattggatatctgcctgccgactcccactttttccgcccagatgtaataccagcttccttttacctcgaagacggtcgcatccagggaaaatgcctcaaacgagaattcgtctccatctgcacgggtcatcttgcctttttccacccacggatcatgtaccggatcatcaccctggcattccagcacatacgggcggatcgcccagatgtcgtccttatcgccgccggcatagtagagataccattttccaaagagataatgcaattccggcgcccagatatggatgctctgcggtccgctctcgtgcttgtgccatacctcatgctcttcggcatccgccagatccgcaagatgcgcggcacggcgcagaacaatcctgtcgtattccggcaccgatgcggtaaaatagtaggttccgtccgtgtgacagtacacataaggatctgctctctgcagaatccacggctcattatatttcaactgtttctccatctttttctccttataaagatccggctgagcccttgccggacgctttgctttttattctgttttattccgcgatatattttacgccccagacactctggtttccgcccacggcagaaaatgtcatcacatcggtgcctgcctcgtctttcatctggcagaacacgccgctgtagtcctctccgtcaatcgtaatgtgcatatagtacgttccgtcaacagcttcccaggttcccgctgcctctcttccgacgactgtaccgtcagcattcaggtacaggatcaccgggttggcaatgtcattgctgatattggttccctgattgatcacaaaatatcttccgaccacggcatccgtctcataaccggtaccgctcaccgtctctccctgtgtctgatacggcaattcgcacggccatccgtcctcgttcatcagcatctgatgtacgcgcggcgaatgattttccgtgccgttgttaaaacgggtatggtagaccagatactgtctgccgtcctcatcgatgaatgcagagttatgtccggtcgccatgtacgcgcgctctaaggacggaagcttgtaattgccggtcagcttcagaccgtaaagctgatgatccacatccgcggtcgggtattccccgttcatatccacataatcgccgtccacggtcttggaacggaacacgcgcacctgatagccgccgctgcttgtgagcgtaccgtaagatacatacaggtaatagtaatccgtcgcctcgtcatagaggatgtaaggtccctcaattgatttgtgtccgcctccgagcagacgctttccgtagtaggcatccacattgtgttcctcgtccgcctccggatgaatcacctgtccggtcgccggatccagctccagcaggaaaataccgccgctccaggaaccatagaccatccacatgcggtcgtcggcatcgtaaaataccgtcgggtcgatcgcattcggatattcctcgaagttataactgttgtttctcacatatttttttaatgcatattcctcgtcgacataatccagcacatcggttcctgcgattgtgtccttgtcaaaaccggaatagatgagcgctccctgccactcgtaaggtccctcgatcgtctcggatgtcccgtagcacaggttcgatgcattccaggtggatgttgtgcaatagtacatgtaatacagtccggtcgtcttgttatagattacatccggtgcccagacatgtgttttcttatcatctgtctgaatcaggctgttcttgctgccggcgtaggcgaacgcctcgtctgccacatcataaatctgaccgtaaaccggattcgtcttgttgtatccgtctgcaatggactcccagtgcagcagatcgtcactttttgctgccgacatatgggaaccgaagatataataagttccgttttcctcatagattgacggatcatgtaccgccaccccggaggaaacgtccccggtctgaatcccgtcgtagctcaccgtaaaattgtaatcggtattctccggcgtctcagactccgtcacattctctgccgcctctgtcgttccgcaggcagcaagtccggcggtcattgccgccacaagcagaacagaaatggttctccttccatttcgcataaaaaaacctcccatgatcttcattgcccagctttagctacaatatatcagataacaggaggtaatacaatatttatttttagttttattaaagtattttatattttatcaaagtttaattcaaataaaaggttgccgccttcttatcgcttccgtcggtgagcaccagtttgccgtcctgcagcgtcagatattgtcccggcatgagcacgctctcaaaggaaactcccttcttgtcggacaatccctccatcgtgtggaatgtctgcgcctgcgccgtctcctccgcggcatccacatcctgtgccagcacaacggtgccgtctgtctgtgctgtcaggtacagtcccgacttgttctcggactggatggacacgtaatattcgttggatgcatccgcctttccgtcacagagcacccatttctcatccgtcgacagatctccgagtccggttccgaccttgacatttttcatcggataatccacatccgccgatgaattgacgaatccctcgtgcgagagcagcgccccgtcgcccgccgcggactgtaacgtcactgcggtaccggcaagtcccgccgtcgtctcctcgaagtaatcgatgctgccgtcgtcattgaaatgcagctccgtgatgcatgcgcttctgcggtaaccgttgcctcccggcagcgagccgttgtgataggcaaaatacgtcttgcctttaaaatcaaagaccgccatatggttcgtgttcgaggtcgaagtcgggtacattatgacattgccgaatgtccagtcaccgctggttaaatccggcgctgtcgcatatgccatgcattctctccacccgtacgcgtaaaacagataataatctccgtagtagttgccctgttcatccgatctgcggtacagccacggcgcctcggtgtaattctcaatgccgcccttctgatacatgatgtccgcatcgtcaaacgaagtaccactggtaatctccccgtctccgttcatatccttgactgaaatcatatcctcattgagctcgcacatgaaaaacatgccgttgccccacgccagataccggtgctcctcaccgttttcatccgtctccacccacgccgtcggatcaatgtcattgaaggtggaaagctgcggcttcgtcacagaaccgcgcacaagcggttctccgatatcgacaaacgtgcccgtcggactgtccgccaccgccacaccgatcgactgcttgccggatttatcccagctgcagtagtacagataatacttgtcgttgtatttcatgacctgacttgcccaagccgatacatcatccttcgcccagtccacggtatccatcgtcatgacggttccctcagacttccagttcaccagatccgtggaggaataacacagatattccggtatctcataaacggaattcgccacctgttcgtccgtcgacgcgtcgtgtcccgtgtacagatacacggtatctccgtccaccagcaccgatggatctccgccataaatccgctctccgccgtcatccgtttttacaatcggattgctgctctccgtcctggcaagcgccacctcttttgcctcgccgcagccagtcagacctgccgccataaccagcgatgccgccactattccataaccatacatccccgggtttttccgtgcactctgccgcttccagctcccccgccatcttttcgtcgtcctgtctgtaaacatttccttctccttttaccgatctcagacgttctctgcaccgagccccgttttcacctgcagattaccatttacctgtaacgcttccatcgtacgacttgtatggtcatgtacacaagttgtattttatggagctgccgctttccgtgtcctgcccctttagcgataagtaatattataaaaagtacctgatacagatttcggatggaactgcatatgaaacattcgttggagaaaaatgtgtgtatttcttccagtcggatgactgcatctgattccgtgtctcttccacgtttggactctcccggagtgtgtccgacaagccacagacaatgagcggactttctagtgtccctaatggcaccgcttcacagacaatataaaaccgcgcgaaccgaaactcgttggcatctgctattgaaaatagggcagatgccaattcagacatcggcttcgcgcggttatgttttgttcattggtgccataagggacacacaaaagtcctaaaattgtctgttggcttgcggacacagtccgtagagtgctccaaacttggaaagacacggatcatcgcagatgcagtcaccggctggttagaaatgccgcattttttgaacagaatgttccataggcattccacccgaaatcgtaacggtgtacttctcataatattacttatcgctaaaaggagcaatacacggaaagcggcagccccataaaacacgccgcatggaggacgctgtcagacacttattactgcaccacgtgatataccagtccgtccttgatgtgctccactgccgcatcatccgcaaaatagcggacaatctcgagcgcaaacggaattgcagttcccattccgcggcttgtgatgatgtttccgtccacaaccacggcgtcctcactcgttgccgcacccgtcagcttttcctcaaaccccggatggcaggttgcgcgtctgccctccagaataccggcagctccgagaacactcggcgccgcgcagatggctgccaccagttttccctcgcccgcaaacttcttaatcacttcgtttaccgtcgcatggtcgagcagatgcagtgttcccggcattccgcccggcagcacgattccgtcaagtgcgccataatccacttcttccgctacggcgtccgccaaaaaggtcacgccgtgggaactggtcacttctctttttccgttcacggagatcatcgtaatgtccatcttcgcgcggcgcacaatatccaccacggtcagtccctcaatctcctcacatccgtctgccataaaaattccaattttactcatcataattctcctcttttctttttcttcgctttcacttttgcattcactatattacgcaatgcacgctcgaaatgctgcgcattcctcgctgtcgggctttcgccctatcaaaagagtaccacactttgcaaaaacgtgctatgatagaatcaatacacaatcaatgcatcagcatgtctgccgccagccggaacactccctgcggcagccggaaaggaattcacatggaaatcgaacgcaagtatctcgtcaagatcctgccggaccacttggagcagtacccctgcaggcagattgagcagggctatctgagcacgaacccggtcgtgcgcatccgacgcagcaatgaccgctatattctgacttacaagggaaaaggactcatggtccgtgaggaatataatcttcccctgaacgaagagtccttcacccatttaaaagaaaaaattgacggtcttctgattcagaagcgccgctatctgattccgctcgcggaaaaatataccattgagctggatgtatttgagggagcgcttgccccgctcgtgctcgcggaagtcgagtttgagactgaggaggaagcgaatacgtttgtcccgcccgagtggttcggcgaggacgtcacgttctccacaaaataccacaacagtaccttaagccagcgcaccttttcttcctgaaccggggcatcagcccaggcgccccgcctcctttaacaggcggtacaaagtcggatccagatggaactcctccatcatgcgctccacctcgccgaggtaccgcttgcggacggcggcaggcacgatcgctctcgccgcatcggatccgccttttttcactgcgcggatcagaaggttcttcggcgtatgggcaaagtctacaaattccagcacctgcgtcttatagccgcagcactcaagcagattcgcgcggattgcgtccgtggcaagtgccgcaaagcgctccttaataattccgtagcgcgtcatcagtcccagatcctccgactggatctgtccgtttaattcatgctggcagcacggcacggaaagaatcatgcgcgcgttccacatgatggcgttgtacagtgcataatccgtcgcagtgtcgcaggcgtgaagcgtcaccaccatatccaccggcgcatccgtgcggtatccgttaatgtctcccacctcaaaatgcagattctcatagccgtactttttcgcggcggcattgcagttcttaatcacgtccgctttcaggtcaagccctgcaatctgcacgtttcttttctgaatctccgtaaaatagtaatacagcacgaatgtcaggtaagattttccacagccaaaatcaatgatgtgaagtgtttctgatgtatcgtccccgaccgcatcaccgaccatctccaaaaaacggttgatctgccggaacttgtcatacatcgtgcgcacgacttttccttcgggtgtaaacactcccatatccacaagcggttctatcggcgttccctcctccagaatatactgctttttgcggttgtggctcccgcttgcctttgccgccgtctgcacattctttttcgtcttgtaggttacttttcccttttgggaacacagatatatatgctctgcagcatcatcccaggcattgacctgcagatactgccccacggccgttttccccagatattccgccagcttctcgggcggtatgttctcgtgaaatacctgtttttccgtataggctgccgcctggtaataggattccttgcgctcaatgacaatccggcggtaagggatctccccacccgccggtttgctgataatgattttatatggtttggcctgcgcaatcgcagataatttttccttctgttcttccatgtactctcctgctctcgtatctggtcagcgcatccgctgcgtctcgtagcgctgctttgtgcggatgcaggctttcaactgctcatagcggtccgccaccggtccctccggaatcacaacatccagcacaaccgccatgctgttgatgagatggtcgtccacctcatcccgcatcgacaccagaatattatatttttcttccagcgtatcagcgtcaaaaaactgcatcagcttcggattcacctcatcggaaagcgactgctccatctggcttacccggatctgatccgtcagctcttctgcctccgtctcctgcacctcgtccgcaaacgatgccgtcgcctgtgcctgcttccgcgcctcagcccgctccatgcgtccgctgccagcgcccgcaagttcgctccggtccacgcgttcaaaacggtaggtctgcgccgcatccggatatttttcacgatcgacctcgctcacaaacatggtgagcggtctcgcatatacctgataatctccgtagagagcctgataaatgaccagtttttctccggtctccgaatgtgttgccactgcgatgacctgataaagtctgtttttaaagtgacgatagatctccccgctctgcgggattctcactctttccattcctgtaaccttccttctgtccctctttgctgtcctgccgtatctttatgcacccatatccagctcataaccgttcagcattgccactccctccgcgataaaatcgcgctcaaacggcagatttgcctgataacccataatcatcagatcctccacctcatgcatcagttcactggcactgtcaatatcgatcgcgttgacgagttcgtgtgctcccgccatcatctgctgctccagttcatccccatcgttctcgctcacattctctgtggcacgttttaatatgtcattctccgcctgattaggctgcggtctgcggcagcctgccatggcagccccgcctgcactctgcgtccgctgtcccagcatctggttcgggcgcacattctgccgtcctgccatctggttcgggcgcacattctgctgccccgccatctggttcgggcgcatgccctgctgctggcgcggcatctggttcgggcgcacgttctgctgctgccgcggcatctgattcgggcgcacattctgctgtcctaccttcgtctgatccggacgcatgtactgctgctgccgcggcacattcggtttcacacgctgtccgttctttctctggaatttctttatctcacttatcaccactacaatcacgatgatccatatcagtccgcccatagcttcccccttattccaatcctcttttgttcctgtcattcatgcagagcccttcgccccacttattcttattatagtgttttcttttttgtttctcaaccagaactttcccctacggtacagttcttctacatccactcccttttttgtcttcgcgttgttattttaaatatcatcattatccaatattgcttttattttcgccttgtggtatgattttatcagattatttttccagatatggttatttaaaataacacgcaaggaggagatttcatgaagaaattatcatctgtgattctggcggacctcgtcgccagcaagagaaaagagaagtccatgacgcagcaggctctcgctgaggcgaccgggatcaaccgcgccctgatctcaagaattgaaaaacaggattttatcccgtccatcccgcagttagaacagctgggagaagtgctcggctttgagccggacagcgtcttcgccgacaccgcgcacgacaggctttcctccccgtcaccgttatgcattgcggttgccggcaccggttacgtcggtctctccatcgccaccctgctcgcgcagcacaaccatgtgacggcggtcgacattcttccggaaaaagtcgacctcatcaaccggcgcaaatccccgattcaggatgattacattgaaaaatatctcgccgaaaaagatctcgatctcaccgccaccttagacggcgccgcagcatacagggacgccgattacgtcatcatcgccgcaccgaccaactatgacagcgccaggaattattttgacacctccgctgtggaggccgtgatcgaactggttctctccgtcaatccggacgcgattatggtcatcaaatcgacgatcccggtcggttacacggaatcggtacgccaaaaataccacaccgcaaacatcatcttcagtccggaatttctccgcgagtcgaaggcgttatatgacaatctctacccgagccggatcatcgtctcaaccgactccgacgacgagcgccttgtggtcgcttcaaggaattttgcagcactgctgcaggagggtgccctcaaggagaatatcccgacacttttcatgggatttaccgaggcggaggccgtcaaactttttgcaaacacctatctggcgctgcgcgtgtcctatttcaatgagcttgacacctatgcggagacaaaaaatttaagcacacgggacatcatcgacggtgtatgtctcgacccgagaatcggcacgcattacaacaacccgtccttcggatacggcggttactgtctgccgaaagacaccaaacagcttctggctaattacaatgacgttccacagaacatgatgagcgcgatcgtggaaagcaaccgcacccgcaaagattttatcgccgaccgcgttctgcagatggcaggatactacaactacgcttccgccaacacctacaattccggcatggagcatccggtcaccatcggcgtctaccgcctgacgatgaaatccaactctgacaatttccggcagagcagtatccagggcgtcatgaagcgtatcaaagcaaagggggcttccgtgattatctacgaaccgacactcgaagacggaaccaccttcttcggaagcaaggtggtcaaccggctcgacgagtttaagaagattagcgacagcatcatcgccaaccgctatgattcctgtctcgatgatgtaaaagacaaagtctacacgagagatttgttccggcgggattagttttatacaaactcctgccgcatcggggtaaagatgtctaagaggatgccgtcttccaggcagacgcagccgtgctcaatatcgttgcgctttaacagtgcgtcgcccggtttgatgactcttctgacgccgtctatctcgaattcaaagctgcccgacaccacatatgtgatctgcgtatgcggatgatgatgcagtgcgccgaccgctccttttttgaagtggttttccacgcacatcagttcatccgtgtacgctaaaatcttgcgttccacaccctcagcacacacctcggcatcgatcctgtcattaaagttccacacctgattttttactgttttctccattgctccatctccctttctctttttggttttatctgtatgcggcattttccccggccgtctgcacattctgcctgccgcattacgatccttcttttaaaatttcttcgatgagtcccatatcatccccgcagtatttttcatataccccgtacacggcattctggaaccgcttcttttcctctgcggaaagctccaccactttcgtgccgttttcaatggcaatgctgcgcgactgctcctcgcgctgtgtccacacctcacgctcgtagagcgccgattctctggcacattccagaataatctcccggtcttccggcgacagtttctgccaggtatacgccgagcagatctgcatttccggcactctgctgtgctcgtccaccgtatagtatttcgcgacctcatagtgccgcatcgcctcgtaggacggccagttattctccgctccgtccaccacctgccgttccaggctggcataaacatctccgtaggcaatgggaatcgccgtggcgccgagcgcctccaccatatcaacggcaagatccgactcctgcacacggatccgcatgcctttcagatcctccagacaggtaattggctgcacagagttataaaaattcctcgctccggcatcataccaggacagaccgatgacatcatccgcgctgacactctccagaaacgcatctccgatctctccgtcaagcacccgccacatatggtcggaatccgtataaagatagggcatctgcagcacattcaggctcggaatatattccgcaagctgcgccagtgacacccgcgcaaaatcaataccgccgtactgcatctgtttgatgactttattctccgacccgagcactccgaccggctgcaccagaatccgtatcctgccatttgtccgctcctcgacaagctctgcaaaatacttggcacccagggtcgtcggataatcttccggctgattttccgcataggaaaacacatattccggttccatctctgtcttggagggatacgtgtgatttctccaggcagacagtgtgagcagtatcaacattccagccacagctgccgccgcgcatatccgtctcatcgctcccccgcctcctttaatacctgcgtccggtattccgtcggcgtgacgccggcaatccgtttgaatactttcgcaaaatagttggagtcacggtagcctaccttctggctcacatcctttacattgataaggacgtcacccagcagttcttttgcccttgccacacgatactccgagagatagacaataaagttcttgtcaaaacactgtttgaaaatcttgcagaaataggcgtcggagtagttcatggcctctgccaccgtctgcaaagaaatgtcgtccatataattgtgttcaatgaacgcctggatattcccggcaaccgcctgcagccggattctcgagcgctccgtatccgccgcgtcctcatgacagtcccgttcggcaaaaaccggctcatcttccttcttctctcctgcctcccggtcatccgtatgctcatcggcaatccgtatagcctccgcaagcactgcctccagttcctgatcctcgaccggctttagcagatattccatagcgcggacggcaatcgcacgcttggcatagttaaattcatcaaatgccgtaagaaaaataatactgcagtttttatctctctctcgaatctgctccgctgcctccagcccgttcattccgggcatttcaatatccagcagcgcaatctggcagttctcggcaaaaaactgttccaccgcctctcttccattgaccgcactcacaaccgcaagctcctccgggaaatatttctggatggttctggttacaatcattctctcaatcggttcatcatccgctatcagcactcgtttcatgtcatatcccccgtttcctctctgcatggaatatctataaaaattactgttcccgcattctttttactgtatatctcaaaatttccgtccgcatacatcgcagtgatccgccggtacacattgccgagaccgattccgctgtgtctggcatcgtccgtcttaaggcggctctttaactgctgcagttcctcttccgtcatcccgatcccgtcatccccgatcactatgtgcagccgcatttccttctgtctgaccacaatgcggatgcttccgccttcctccttcggggaaactccgtggataattgcattttccacaagcggctgaaaggtaaatgccggaaccatgaccagttcctgttccaccttacagtttaattcataacggatccgctccccgaagcgcatctgctgcaggtacatataatctgcaaccactttcagttcctttgccagcggaacggactgttcgggtgtctttaaattgtaacggaacagggaactgagcgccagaatcatcttttcggtcgtctctgcctcctcaagctttgccattccgctgatgacatttagcgtgttgaacaaaaaatgcggattgatctggctttttaacaattccagctttatcatctccaggcgtttctccgtctccagctttcccagctcctcctcatgcagaagatcaagagtcttcctcttttcttccagcgccataatgtactcgcctgtcgcgtatttcatcttgttgaacgcatgcaccagttcccccagctcgtcctcattctgcacctgcacgtcctccgagaaaaaatcattggcggcaatgcgctgcgccgctttcacgagcgccaccaccggcgagataatggtctggttcatcaatgccgccagctccatcatgccggttacgagaataatcccagataccacaaccacaatcggcatgcatatgagcatgggcacctttttatgatagaggccgtcgccgtcctcgatcgtctcattcatcagcgtcgccgcgtattcctcgagatagtcctgcatctcgtagacctcatacaggcgcttgatatagtccggcgcattttcccccatcgcaagcatggcgtcccgcttctggcaatagacttcataacagctcttgatcgaccaggtctttgcgtagcgctgctctccaatctcagaatagcggaacggaagcttttccaccgctcttccggttcgttctatcgcaatatccagactttctctctcctcgcgattgccctttatgtatgtctcaaactggatactctcttcctcgagcgcctgtgccagttcgctcaccgctgcgttatcctgtaaaatccggttaaagtcgatcagggaaaacttgacaacccatacattaaaaagaacagagactgcaatgatgagaaatactgtcccggtaaacgtcgctattttctttttgatcgtaagtgcctgccagaactgttttatcctctttctcacgcttgtttttcccatgcctctctgttctctctataatgcggcaaaagcaaagccgtagatacacactccgtaaatacagctttgcatatttgctttatctattctgttccactttgctctgtacaaaggaccaaaacgcctcccggtcggctcccagcacacggttggtcagcatatagccgcttccggctcccgaaagcaccagcaccatccccggctgttttgtaacccgcagccggttccacggcagatgctgtctctctcctccggttgtaacgagcagccccttttcatcaaaggtaagcctgacatcctgcggtacagccgccgcctgacgcctggctttcgcatagattgccgccggctggatgaccgggaacagtaggcatccgatcagcatcagaacctgcaggacttcccccgactgactccagaactttgccgtaagaaggatcatcgccaccgtaaataccagattacacatccccgccatggagcggtaggtctgacgcatggtaagccggaaaaaatcccatgccgtaattctgcacttatattgatattccatatgccatctcctctgtattcacaaactggctccctttacgttccaagtaacatcggaagtccgatacttaattccggtataaaggtcagaagtaataatacaacgatcatacacagatagaacgggagggttgcttttaccacgcgctccatctttacaccgctgactgcagaaccgatgaaaagaactgatccaaccggcggtgtcagaaggccgataccacagtttaataccatgatgataccgaactgtaccggatcgataccgatggaggttgcgatcggaagtaagatcggtgtcgcgatcaggatgatcggtgccatatccatgatacatcctaaaatgagcagaatcaaatccactaacagtgcaatcacgatcgggttgctcgagaatccgatgattgcctttgcagccagatccggcacatgaagtgtcgtcaggcagtaaccgaaaatactggatgtcgaaattaagatcaggacgatagacaatgtatcaatgcactgctccaggctcttccagacacccttccaggtaagacccttgtaaatatatacactgacaatcaagctgtagaatactgcgatcgcagcggactctgtcgcggtaaaccatccggctacaacgccgacaactacgattacaactgctgccaatgcccagaaagaagttccaagctgttttaacagtctcttgacactgaacttatcccccttcggataatgtctctttttcgagataatataagatccgatcattaaggagatcgcaagcagtgcgcccggcacatatcctgcaaggaaaaggcttcctaccgatacaccgccggcggacattgcatagattaccatgttatggcttggtggaaccagcagtccctcacaggaggaagtgatcgtaaccgccgtcgaaaaatcatcatcgtatccctgatctaccatcatcgggatcatgatacttccgatggaagccgtatctgcagatgcagatccggaaataccgccgaagaaataggatgcaacgatatttaccatcgccattccaccggtcatccagcctacgcaggcatcggcgagtgcgatcagcttatctgatatacctccggtgcccatcagcacgcccatcgtgatgaagaacggtacagccatcaaactaaaggaactgattccctttaccatctgctgacagatcgttgtcagcggaagtccctgcgataacaggcacagaagggaagataacgctactgcatatgcaatcgggaaacgcagcagaatcatgacaagaaagcttacgagcaacactgcgattgccatactctgtacactcattatttcgtcccctcctttacaaaaatactcttaatatgattataaattgcttccagttcaaaaacgaccatcgctacgccggcaagcggaatcgggaagtacatccagaacttggacagccacggcatgctgacgtaattacccttggctccaatgcctgtcgcatagctgaatccaacggtaatcatcacgatcgccagaataaagacggcgacatctgccagaatatccaatgccttaataacatttttcggcaggtatgcgtcaaacgccgtcatacggatatgtgcatttctgcggattgcaagtgccgccgagagcactgccatgtaggacatcagggtcagtaccacttcctcgctccatgccggatcgggtacgaaggaaacatatcttccgacaacgcagacactcgtgattacgatatctgccgtgagcagcaatttgcatacaaacagtacaaacttatatgccacatcatatgccggctttattttatctaaagtctgaaaaatcttaggcattttttcctccttaaaaaagtcggggcacgggggagcagccattctccctgtgccccttgaaaacgcacttacattattgcgggttttccttctatcaaacctataagtgtcaatctttctgtcgattactgcatatcaacgatctgctgatataactctttgttattcttggttgcctcttcgatgacatccttgcaggcatcctgccacggtgtgatatcgtctacttcaataacattaacgccgtctgcctttaactcctcaaggatcttatcctctgtctcctgggagatctgacggttgtactgggaagcatactcgccggcctcggtcagcacatcctgctgctccggtgtcagggaatcccatgcttcgtctgtgataactacctggattgctcctaaggtatgtccatcaagaatgatgttcggtgctacttccgggaatgcatttgcctgatagtttgcgatcggctgttctgctgcatctaccacaccggtctgtaatgcggaatataactcacccatggcaacaacggtcgggtttgctccaagtccttccaccatacctgtcatgatcgggtcgttggatacacggatcttcatgcctgccagatcatccattccctcgatcggattgacggtgaagaaatggcggaaaccttcctcgccgtagaacagtccgcggataccggttccgttctcatgcggctcaagcaggaactcctgtgccagatcagaggttgcaaagttccagaaatgatcgcggcttacgaatgtgaacggtacggataagagactggatttctctccgccgtagcttgtgagtgcgaatgcggaaatacgtgccatatcgatggtaccgccgccgccgagcatggtgtcgagtacatcggactctgcaccgagaacaccgtttgcctgaatatcaatcgtaatacttccgccggaaagctcttctaccttctctttgaatgcggttgctgtctgtcctacaatggttccctccagcgggtttacctctgcgtataccagagtcactgccggtccgaccggctctgttcctgtggaatcaccggcctcggttgccgctgcgctatccgttgcatctgccgttgcatctgccgctgcatctgtgttctggcttgtcgtcgtgtcggcagcctctggcgctttcagtccacaggcggtcatggaaaccaccattgctgcacataacagtgcggataaaacttttttcttcatgtaaaaatcctccttcttctcctcccgccgcgcttcatccggcggctttgtttatgtcttaattataaagttctatcctcacaatgaaaaccgtacatttttattaactttagcacatttttaacaattttaatagtttttttatatttatatggtcaaaatattctatttctttctgaaattctaacgatatacagatgaaatgcacaaaaagagccagtacattgactggctctaatatcttggaaatatcttacagtttattttgataattcccgtcctgttgctctggcatccttcacctgtcctttttcaacttttttattccatcaaacctgcatagccaaacgaacagaactccatttactccgcaaatgtctctgccaccttcacaagcaggtcgcggatcggcagatgctgcggacattgtccctcacacttgccgcagcggatacagacatccgcactgccaccgtcagcggtatgccgccggtaactgccgcggtttgtctcattgatcccgaactgcacggtcatgttgtaatcctcaaagacatccgggatcggaatctttttcggacatccctccacgcagtagcggcacttggtgcaggcgatcgtcggcatggcggcaagctcctccaccacccgggcgatcgctgcgcgctcccgctcatcaagtggtctgaactccctcatataagccgtgttgtcgatgagctgctgctcgtccgacatgccgctcaacaccagcatcacattttccagtgatgccgcatagcggatcgcgtaagatgcaaagcttgcctctggtgaaagctcctttaagatctctgccggtctgccggtcatgttggcgagtgttccgccctttaccggctccatcacgatcaccggtacaccatacttttgggcaacctcatagcatttgcgggactgcacattctccgactcccagtcataataattgatctgaagctgtacaaattccatctccggatgatttttcaggatctcctcgagcgcttctgccgtatcatggaacgaaaatccgatatggcggatgcgcccttccgtcttcattctctgcacaaacgcaaagccgcccgttttctctgtctcttccacccgtgtcttgttcatggcgtgaaacagataaaagtcaaaataagtcacgccgcagcgcgccagctgcctctcaaagatctcgctgtagtcctccatgttctgtaccagccacaccggcatcttgtctgcgagaaggaagcgctctctgtcataacgctccaccagacagcgacgcactgcctcctccgacttctgattgtggtaagggtatgccgtgtcaaaatagacaaatccctgctccatatagcggtcaatcatcctgcagaataccgcgtcgtcaatctcttcgctattgccgtttgcaacgggcagccgcatacagccaaacccaagcttcttcggcatgatctgttttaaatcttccataacacatctccttctacatcgtgcagaactgctcaatctcttccgcaatctcagaaagtcccgttctccagaaatccttctttgtgaggtcgattcccatcattgcgccagcctcctcgatcgtgcagcacggggttgccgaaagcattgccttatatttcccaataaaagcctccccctctttttcaaactggctgtaaagtccaagcgcaaacagattgccaaaagcatacgggaaattgtaaaagctcagtccctcgctgtaataatgtcccttgcacacccacatatacggatgcatgcattccgggtccagcccgtcgccgtacgtcttcttctgcgcgtccagcatgatctgctttaaatcgtccgccatgaggaacttattctggctctgttcaaatactgccgtctcaaacagatagcgggagtaaatgtccacgatacactgcgtctgctccttgatgtcgttctccagcagattcaaaagctcctctccggatgcctctgcccgggctgcctttccgagatgcacctcgttaaaggttgatgctgtctcggctaccggcatcgggtagtcctgattaagcggtgcgtgattctcgatctggcggttgtggaatgcatgtccgagttcatgtgcaagcgtgtcaaccgatccgaaataaccgtcgtaattggtcagaatccggctctgttttaaccacatggctcccgcgcagaaagcaccgccctcttttccttttctcgggtagaaatcgatccactcgttctcaaacgcttcccgcatcagatctgccatctccggtgtcagctttgtgaatgtatcaataagatactgcttggcctcctcaatgctgtaggtcttatctgccttgccgagcggtgcaaacagatcataccacggcaggccgttgacatgtccgagcatcccgccctttttccgcagatacttgcggaataccggcaggtattcgtcgatcgccgccatcatagcgtctaaagtctctcgtttcatgcgcgactgctctaacgtcatggcaagtggtgaagcatagcctctcttttcgctgagcatcgtcacctggttcttaatgtaattcagggaaaacgcgatggcatcctccaccttctcataagcggcaatctccgcctcataagcgctcttgcgcacggaagcctccgggctgtacgctaagtttcttacttccgacagtgtaatctgctttccctgataatccacttttaccgtggaggtcagataggactgcagcttcgaccacgccgcgccgccgctcatgttcatggaggcagccatctcctccacttcatcgctgagcagatgctttgcctctttctgcttctctttcaggtaaaatgtatgctcacgcacaagcccgctctcttttgccagcgcatccacgtcccggattcccgctaaaagctttcctgccgcggcctctaacggtgccatttttgcctgaagcttcatcagcttcgcattttctgccatcactgtgccgtcctctgtattgacggactgtctcaattccacatagagcgataactgatagaaaagctgtgcgatcccgctctgcgccgcaagcaccttctctgtcctttccttttcctgcatccttccggcatctgcaagcagtgtggcgagcgcatcgatctgcgccgtaagctctgccacatcctttccatatgccggatcatcaaatcctttataaagttcgtctaacgaccattctgttgtcattattcccctcctgtaatgtttttgcttcccaggacacctttcctgtgaagcgaaaaaagtgtcccaccgcttgcatgcggcagaacacttttattatagcatggattctatttctggtaaatctgaataaaatttgtgaccacttccacaagcttttcatagctcatggacgtcgtgtccagacagaaattataatttctggcgtcattccagtctcttccggtataatagcggtaatattccgcgcggtacttgtcgattttctcaatccgtctctccgcttccttctccgagaggccgttctggttcatcactcgtgcgacgcagtccttcttcggcgcacagaaatacagtttgatgacatccggatcatcccggagtaaataatccgcacaccggccgataatcacgcaggattcctgcgctgccagctctttgatgaccttcgcctgataattgaacaggttatcatcggacacaaaatccgaattctccggcggaatcacaccacccttgtacggatttttcttcaaaattccaaacaacggagaccgcttcaaccgctcgtctgcctgtccgaaaagtgcctcgttgatgccgctggcatccgatgccattcttaaaatttccctgtcatagcagttgattccaagctgctcagccaaaagctttcccagtgttcttccaccacttccatagcttctcgcaatggtaatgactgtttttttcattccattctacctccctgcattttccgtctattctcccagatatgccttcttaatagaatcattgttcatcatttccttcgcgtcaccggagagaacaatatttccggtctcaagcacatacgcgcggtttgcgatcgcaagcgctttcttcgcattctgctccaccagaagaaccgtcgtaccgctcgctgagatctcccggatgatatggaaaatctcctccacaaaaatcggggaaagtcccatggacggctcatccatcagaatgatcttcggcttggacatcagggcgcgccccattgcaagcatctgctgctcgccgccgcttaacgttcctgcaagctggttttttcgttcttccagacgtgggaaactcttgtaaacctttgccagcgattccgcaatctcgtttttgtcttttctggtataagcgcccagcttcagattctcgtagacggaaagttccgcgaacacgcgccgtccctccggcacatgcgccattcccatcgatacgatcttatgtcccggcaccttcacgatatcctgtccctcaaaaaggatctcaccctcggatggctttaacattcccgttatcgtctgaagtgtcgtcgtcttccccgcaccgttcgctccgatcagcgcaatgacttccccttcgtttacttcaaacgagatccccttaattgcctgaatgacaccataatgtactttcagattttttacttccaacattgccatagtcgttcctccatctatctcatgtcattctccaagatatgccttgattacctgcgggtcatgaagtacatcacccgtcgcgccctccgcaagtacctgaccgaagttaagcaccgtcagcttctcacagataccggacaccagtttcatatcatgctcgatcagaaggattgtcatatcgaactcatcccgcacaaaatggatcgtttccatcagctctttcgtctcgttcgggttcatgcctgccgccggctcgtcgagcagcagcagctttggattcgttgcaagtgcacgcgcaatctcaagctttctctgctttccgtatggaagattggaggacaggaaacccgcctcgcgctccagatcaaacacttttaataattccattgccttctcatccatctccgcctcaaccttgcggtatttcggcagacgtaagattccggtcagcgtcgagtaggacatctggttgtgcagtccgatctttacattgtcaagcacgctctgatccttgaacagacggatgttctgaaatgtacgcgcaatacctgccttgttgatgtcgatcgttttctttcctgtgatatccgcaccatccaggctgatagttccctcatccggcgtatacacaccggtaagcatattaaataccgtcgtcttgccggcaccgttcggtccgatcagaccgtacaactgtcctttctcgatggaaatatgaaaatcatctaccgcacgaagtcctccgaaggagatgccaagattctttacctctaacattgccataactatactgcctccttctttgtgtttttgcggaacttctgtgccattttctgtctccattcaatgcacttcggagcccagttgaaaagcatcatgacgatcagcacgatcgagtagattaacatacggtaatcggacagtcctcttaacacctccggaagaagggtcaaaagaacggctgcaatgatggaaccacggaaattacccataccaccaagtacgacgaataccagaatcatgatggacatattgtaaccgaagttcgccggcgtcgccgtaaccgtggaaaggttgtgcgcatagagcacgccgcccgctcccgcaatcgccgcagagatcgtgaatgccatcagcttgaacttggtgatgttgatgccgacagactctgccgcaatacggttatcacggattgccatgatcgcacggccgcttctggaattgaccagattgtatacaacaaataaagaaatcagaattaagatcacgcccgctgtaaagctggagagatgcggaatctttgcgattcccttcgcaccgttaatcagccagacaccgtcatctgcgagatcaatcgcgtttccgttcgagattgcaaagtggaatccgcttccgtcttttgcgatataaagaacgttgatgatatttttgatgatctcaccaaacgccagcgtcacaatcgcaagataatcgccgcgcagacgtaagaccggaatgccgatcagaaatccgaagaatgccgccatcgcagtgcccacgagcagcgcaatgataaagagcactatctggctgccgatcacaccttccagcatcttggtgcagaaggcactggaaaaagctcccacacacatgaagcccgcatgaccgatactcagctctccgaggtatcccacgcacagattcagaccgatcgccacgatagagtaggtgcacatgggaacgagcagtccctgcatcagcgaagaaattgctccggcagctaccatgatctgaaccacaatatataccgcaatcaccaacacaaaggtgatcagctggtcttttgtttttttattcaccgtttttaaatttaactttgccatagctgttctcccttttgcattatactttctcatgaatctgttttccaagaattccggtcggttttacaagaagcacaacaatcaaaaccgcaaatacaatcgcatccgaaagctgggaggatatgtaggcacgtcccagaatctcaataattccaaggagaattccgccgatcagtgctcccgggatcgatccgattccgccgaaaacagcagccgtaaatgctttgatacccggcatggaaccggtgtacggtgtcagcgtcggatacgcggaacagaacagcacacctgcgatcgccgcaagtccggaaccgatggcaaaggtcagggaaatcgtcgcattgacattgactcccatgagctgtgccgcatctttatcctcggataccgcaagcattgcctgtccggctttcgtcttcttaatgaacatcatcagtgcgatcataatcaccacgcatgccagcacggtgacaatggttgtgccggaaatggtcaacgcgccgtctgccagctttaaggaaggcagggacacaacggaactgaatgatttcgtatccgctccaaacagcagcaatgccgcattctgcaggaaatagctgacaccgatcgctgtgatgagcacggcaagcggcgttgctcttcgcagcggcttgtaggcaattttttcaacaacaattccgagaacggtacatacgatgatggagagaaccaccgccggaagcgggctgatcccctggccgctcattgcaaggaacaccacatagcacccgatcataatgacatcgccatgtgcaaaattcagcattttcgcaataccatataccatggtatagccgagtgcaatgatcgcatatacgcttcccagactgattccattgatcagataggataagaaattcataacaacacctctgtctttccttgtttaatacgttaaaacgtcagcagtttcacttattataacatgttacatacctgtatacaacttaaaaccgaaaaaagaagaggttccgcgccggcgggtagtcgcccccgccaacgcgccaacctctttattggcctttcctgcctgctctattacattgctgaataagcaccgtctttgattacgactgccttcggcgccttgctgacctcgccggttgcctgccatgtcatggaatcaccagtcaaaccgtcaacgctgatctctgccatagccgcctcaagtgcactgccaatatctgccacgctcatatccggtgtcacgcctgcctgctctgccgctgctttgataatgtagattgcatcgtaagcatctgctgcgaactggttcggtgtatccccatatgcttctttgtactttgtaacaaaggactgtgtcttctcatcatctgcatctgctgcaaacggtgtcaagagcattacgccctctgccagctctgtgttaaaattctcaacaccaagcagtccgtccagaccgtcgcatccaaagaatgtcggagcatatcccatgctgtctgcctgtgtcaagatgatggatgcctctgtgtagtagatcggaaggaatacaagctctgcacctgcgctctgtgccttctgaagctgtgtggagaagtctgtcttggaatctgcggtaaacgcttcttctgcaacaacttcaagtccctgattctgggcttcttttacgaagttcgcctcgataccggaagaatatacatcggaactgtcgtagatcactgcaaccttggctgccagcttgttctcaccgatatactgtgcggatgcagtaccctggttcgggtcggtaaagcatacctgaaatacattatcattatcgattacatccgtggaagatgcggacggtgtcagttcatacatgccgtcctctgcggtcttctcaacaactgccacgcagggagtcgttgtaacggtacccatcagcatctgcataccccaatcctttaaggagttgtaagcattgacggatttctcggcatcatgctggtcatcctcaaacttatatgcgatctgatatccgttgataccgcccgctgcgttaatctcatcaacagcaatctgtgctccgttcataactgctgtaccgtagatcgctgctgctccggtagtcggtccgataccgccaatcttaaatgccgcgccatctgccgctgcggctcctgcgctctctgtacctgccgctgcgccgttatctgtggtcgtaccggatgctgctccgtcggaagagcttccacagcctgccatcatacttgcagccatcgctgctgtcaacaatacactcaatgctttcttcataatattgtcctccctcaagtgcctttatcttttctgaaataatagcaaaattagagatgattcacaatgttaaaattacaccaaattcttgatttattttatcgtatgattatgcaatttgtctttttcaataaccataggttatattgcgtattccaggcggctatattgtccgttcttctgcattttttaactgtttgacgggctttcttccgtgttgtaaatatacttgcgcgtcataaaacgcaccatctgctccgcctctgcccggcggcacagttccagaaaccggttccagaaacgctcgccgcagtaatccaccagatagctgttgcgctgcgcattctccatctcccgcaaggatccccggttctcatgtccgagataatatgcaagcgcgaagaaatccggctcctcccagcctgtcgcatccttcaataccgccgccacattctcaagctcactccgaagcatgatcgctgccagcttgctccccgcctcggtctgcgccttcgccgcgtgctcctcatactccgctaccatctgttttaagctctgaatcgtggactgaaaatcgagatcgtcatcccggatggaacaatcatgatagacctggtccagatctcccatcagctcgtccaggctctttttgacttcacttaccggactttccttcatgcactccaacagacgctcaatcgccgccctcgactgcgcgaggtgccttctcgcctcctcatactgttcccgcagagtatccccctgttccagcgccgcctgataatccctcagcgcctcattcacatacgccttctcgccccccgcattcagaagactcttttttaaatccttcaactccccttttagctcttttgacttctttcctttcgcagctctgtcaaacaacatttccctcgctccttctcccgatctgacatttctaccctttattatataaaacccatccgtcatcttcaagccaatttcaagcgaagaggctgacgcttcaagcggcagcctcccaggatagataagtaaataggataaaaagatcacacctctcgatttcgatggaatgtagatggaaatccggatcaaaaaaagcggcatttctagccagccgaatgtctgcatcttcgatgatccgtgtctttccaagtttggagcactccgcgggtcatgtccgcatcccggaagacaatttgtaggacttttgtgtgtgtcccttatggcacctctgagcaaaacataaccgcgcgaagccgatgtttgaattgccatctgccatgtttttaatagcagatggcaaagagtttcggttcgcgcggttttatattgtctgtgaagaggtgccattagggacaccagaaagtccgcccattgtctccggtgtgtcggacatgcacccgtcggattgtccaaacgtggaagagacacggaatctgatgcaaacattcagccggaagaaatgcacgcatttttttcaacgaatgttccatctacacttccagcgaaatcgaaaaatgtgatcttttatcctagtacatctctttcgacgccagctgtccgcctgaagcggcagcctcccgtctatttttcatcatagagatgacattttaccttatgtccgttgccaacatccttgacctgcggctcctcgtgcttacagatctccatgcactcactgcagcgggtgtggaacttacatcctgcaggcggattggccggggaaggaatatcgcccttcaaaaggatacgttcctttctgacatccggatccggcatcggaatcgcggaaaacagcgctttcgtgtacggatgcaacgggtttccgaaaatatcggccgtctcgccggactctaccatgccgccaaggtacataacgcccacggtatcagaaatatgctctacgacagacagatcgtgagagataaacagataggtcagtcctctctccttctgcagatcgcgaagcaggttaatgatctgtgcctgaatcgacacgtccagtgcagataccggctcatcgcacacgatgaattccggattcagcgcaagcgcacgcgcgatacagattctctgtctctgaccgccggaaaactcgtgcggataacgatccttgtgatactcctgtaatccacagtccttcataaccttggtgatataatcatcaaactgctccttcggcacgagtccatgctcacgcactgcctcaccgatgatctcaccgatcgggagacgcggagacagggatgaatacggatcctggaaaatgatctgcatctttgtgcgcagatcgcggagctgcttcttatcgtacttgctgatgtcctcgccattgaagagaatctcgccgtctgtcttctcgatcagacgcaagatcgttcttccggtcgtggactttccacatccggactctcctacaagtcccatggtagtgccgcgcttaatgttaaaagacacgtcgtcgaccgccttcacactgcctgtcgcaccgccgaagaaccctcccttaatcgggaaatactttttcagatgagacacttcaagaatattgccgctctgattggttgtctttgttgcttcgttattgctcattcttcgtgtctccttccttgccgactgcctccgccgcacagcggtagcagcttacaaaatgtgtcggggaaatctggtacattcccggatatgctccctcacagccgtctacgcacatctcgcagcgatccttaaagtagcagtagttcggcatatcaattgggttcggaacgcttcccggaatgctgtaaagcttctccgtatatttaccgaccaccggctttgacttcatcagtccgatggtatacgggtgtctcggatctttgaaaatctcgcgtgccgttcctttttccacaacacgtcccgcatacataacgaccacgtaatctgccatctctgcaaccacaccgagatcgtgtgtgatcagcatgatggagctgttgatcttatccttcagtccgcggagcagatcgaggatctgtgcctggatcgtcacatcgagcgctgttgtaggctcatcggcgataatcagacgcggattacatgcaagcgccattgcgatcatgattcgctggcgcataccgccggaaagctcgtgcggatacatccggtatacgccttccttgttggcaatgccgaccatctcaagcatctggatcgtacgtgtcttgacgtcatcctttgtcatatccggattgtgaagtgcaatgacctcatccacctgctcgccgatacgaagtaccggatttaaggaggtcatcggctcctggaaaatcatggacatgtagttgccgcgcagcttctgcattacagaagtcggcgtgttgaccacattgtatacatgatcgccggtattaaagcggatctctcctcccacggtctgaccggatgggcgctgtaccagctgcatcagggaaaggcttgtcacggattttccgcagccggactcacctacgataccgaccgtcttgccctgcggcacatcaaacgatacaccatcgacagacttgaccgttccgatgtccgtgaagaaataagtctgaacgttgtcgaactcaacgcagttctccggattcttcatctttgtcacatattcctcctccggaatatgctttctgtttctttttttctcgatctcctgcgtaatcttgcggttctcccgcgcaatcgcgcgggattcttttgcggagatataatttgcgtttttcttcttattattaaatgccattcctgtcacctaccgtttcatcttcggatcgaatgcatcacgcagaccatcaccgataaagttatatgcaagtaccgtgagcaggatcaggacgcctgccggaacccacacgaataaatagttcgtcataacgtaagagtcgttgaccgcattgatgatacttccccaggaagccgccggatacttgataccaagacccaggaaactcaatgtggactcggcaagaatgacatcaccgattcccatacttgcgaatacgacaagctgcgggataacattcgggatcagatgtctgaaaatcctacggcttacgcggataccggttgcctctgccgccgtcatgaactcctgctctcgcagggacaagatctgtccgcggataatacgggcaatgctgacccagccgatgatactcatgacaatacacagcatgtagatacgtgtctttgccgaagccttgtagtaatccatgatcgaaccgaggatcagatacagcggaatcgccgggatacagtaaacaacatcaaccacacgcatcaggagtgtgtccacccatccgccgaaaaatcctgcgataccacctacaatgataccaatgataagctcaatgataactacgacaaatccgatcataagggaaattcgtccgccgtacatcagacgcgccagaagatccattccgttgccatccgttccgcacagatgctttgcagatggtgccgcataactgtcgatgacacgcgtctcctgatagcgctgaatcgtatactgaccgtttttatccttgatcagataggtgtcggtctcaccctgctcgtccgtatactcaaaggaattctccccggcagtcattgcagcctcagctgcctccttgaacgccggtgtcagcacgataccactggaaaccggattcatgctcatatcagatacataagcataatccgcaccgtctgccgtatgaatcatggcagcgctgccctcgttttcaaccgtgtagttcacgccgtccgcctcaacgttcttatcgccgtttgcaatcgcagtcagcaccttgctgtaaaaatcataagaaaatgttgtgccctcatcaaaagctgtcacagacttccggcaggcaataccaagctctgtcgtcgtgtacagtgtctctttcacaccggatgcatcaaacacatactccacgccgttgtaagtaaactggttctgtccggctgcctccgcagcgtcatgctcctcagactttaatgccagcggattcatctgctgctctgccgcgtagatgtgatatgtgtcgtcatcaattttgccaagtgccagtgtctgtccatctctggtctcgaacaccagggcatttttcgtcacggccaggatcatcttggaatacacatcgctcggaagctccacaccgtccgctgcaaacacctgaaactcatcaatttttgccgcgccggcataatccttcttcatctcttccgtgcggtaaaagacctcactctgggaatacggattgactgcacctccgacaaaggcaaacaggaacatacagataatgataaccagtcctacaattgccagtctgttgcggaaaaaccgctttgcaaccatcattccgggggaaagtacgcggacacgctgcgcgtcatcaagcttcatattattcttctcgttctccatgttctctcctcctttctagttcacgcggacacgcgggtccacaactgcgtataaaatatcggcaatcaggttgccaagtaagatcaacactgcggaaaacagcatgtagaacataacaaacggaatgtcaccctgtaataccgcctggtaagaagtatatccgatacctgggatctggaacagcgtctctgttaccatggcaccactgaagagtcccggcagtgtaccgccgagcagcgtgataatcgggattaagatattgcggaatgcgtggtaatgaatgacacgcttctccggcagtcccttcgcgcgcgccgtacggatgtaatccgcattcagcacttcaagcatattggttctggtgtaacgcatcagggaaccgatgctcacgatcgtcagtgtaattaccggaagtaccagatgccatgccatatccagaatctgccgtccggaggaaaggctctggaagttacgtccgacaataccgtagaggtcgaaccagccaagctttacggaaaagacccattttaaaagtgttgcaacgaaaaagctcggaagagaaataccgaccagtgcaataacggtgattgtataatcggttgcagaatactgctttctcgcagcggcaatacctgccggaattgcgatgatgatctccagaacaaaagatgccagtgacagtgcaaacgaataccagataacgcttgcgaatttggtcagtaccggctggttaaaataccaggaatcaccgaactgtccgcggattgcttttgctgcccagcggaaatatccctggatcacaccggtgtccagaccgtacgatgcatttaactgtgccacccattcgtcataactctttgctcccggtctctgtgacaatgtcagtgcctgctgctccacgaatgacgacggcatgcaacgcatgatcgcgtagatgatcatggagacgaagaacagtatgacaatcgagagcaatactctcttaacaacaaatttcttcatgattctttttcctttcctcgctgcttctgatgctaaaggtattttgcaaaaaggcgtcacgcatcctcttgcaaaatacctttaaatccctatgcaccatggcacaggttgtagaagaggggagcctgctcccctctccctccaccatcagccagttactctgatccttagttcatctggatcttctcaatctcgttgagatagctatagaaggttgtcagatcctgcggaatggaatccacattgacacgctgtgtactgaatacagaagcgttctgtctctgatataccggaatctctacagcgtaatctacgataaagtcaagtgcttccttataaactgccttacggaatgcctggtcggtattggttcttccctccattaccagttcatccagctcgtcagagtagattgcatagtagtttgcgctaccgccttcgctgtgatagatctggaacatatccggatctaaggttgcctgccatgctgcacaccacatctctgcagtctcactgtttaacgcatcccacatgatggttccgtcagccagatcgttgattgtcagatcaaagccgatggtcttaagtgcctcggatgctgcggtcagaataccgaaggaaggatgatctccctttccgcctccgccgatcattacctcatagcttaacttcgcaccagccggagctgctgtcagcttgccatctgttactgtgtaacctgctgcctcgaagaatccaagtgctgcgtcaagtgctgcagcatacttctcgtcatccgacataccgtctgtgtagatcgggttgccgtctacgtccttggagaatgcaacctcgtagtctgcgtcagacttctgcggtgctgcccaggaagtattggagatcgggtagttaattactgctgctgcctctccataataggagtcgataaccatatcacgatatacagaaattactgttgcgattgcttttcttaaatctttggactgctcagaagaaggatcatcgccaaccttgacattctgagagttgattccgatgtaaccataaccattgttgtcatacagagcggtggttaatacatcaccggacacctcaccgttgctgttctcagagcagatctgtgccataacctctttggagatggacggatcagaaatatctaccgtaccctgaacaacacccggaagcttatctgcctcagcggtctccttgaactggagttccttggtagccggtgctcccttgtagtatgactcattcgcctcgagatatactgtcttgttctcgtagctcttgaagacatacggaccagcgccaagcggagcggtcgtcttctcgcggattgcggaaagatcaccctttgtgaaaccgaactggttgttatcgtaatcgtactggctctcatcaccataataatgaagcggtgtgatctggatatccatggtctgaagtgccggtgcgctgacctctgtcagaacaacacgtacggtcttgtcatccagcttctggataccggaaatatttgctgctgcatcaccggtctcaacaccttcggtagcgtatgcatatacgtcttccggaatcagatcggagagagcgcttcctgcagactcagcctccatagcggtgaagctccatccgtacttgtcaccgattgccataaagaaatccttagcggtcgcatctgccgcaagaccgtcgaagccccactgtgctgctgcgcctgctacgtcgccctcttcgctgacgccgttctctacgcagtaatcaacgatttcctgtgcaaatgctgcaccaccatcgtttacagcatcccagaatgcgttctgctgatcttctgtccagtatgtgaagtctgtgttatcctcgcccgctgccgcaagtaaagatgccaatgtggacataccgcttctgtactcttccataccctcgatcgggagagagtatacagatgcgcctccgtcataagtcggatcgcagaatacatagaaagagaagatgatatcatctgcggttaccggctctccatcggagaaggtcagatcatcacgaagcttgaaatcatagtatacggttccgtcttcgttctctgtgatagtcagatcggttggtccgtagtaagtataatcggtaccgttgtacgaagtggtctcaccctcgataccattgtagataaactcaccggaacgatcgttgtaaaccagagaaatctgtgtcacatcaacgatgttctgatccggcacactctcagcgaagaatgggctgaacttctcgctcataccgtcatttgcgataacgagcggtgtgtcgctgccggatgcagccgtgcctgctgcctctgtgcctgctgtctcggttccagctgtctcgccgccagccttgcttccgccgcagcctgcaaatgaaccgacagtcagtgctcctgccagtaacaaagcaagagtctgtctcatttttttcataatatttcctccttataaaaatattatctatgttttaaccttataaaaggaaaaaacctactccattgtggcattctcaatcagaatgccgctgtaattgcggtcataatactttccgaagaaaaatgcaaccgccagaaacaggaaatgacatatcagatagatacattccattcccatacggatcccaccacggtgcagcaccatgtatacaaggtccagaaccgctccgattcccgtcagcaccattgccccgatacaggaacgcttcatgcgaagcagccccgtctcatagtgtgcccggtgcatacggaccggtgccccgatatagctgaccgcaccataaagcatgtatccaagcggaagaatcacaaacagatacgggaatacaatccacgctgtgcgggacgaatccggatttaaaagtcccattccaagctcaatcacccacagcgcgatcgtccagatgacattaaaaatgcctgtccgccgcttctgctgttcatcaaacggaagcacataaaaatctccctgataggacgttcttgtcaccagaagaccgtgccggttctgctttaattcattttgataatccttttggtaagggttcttgatcatcgccgcttccgcctcatcgctctgcctgccatactgcatagtgcaatattaccgcgttattgcgctaaaatatttttgtgtaacaaaaaaaagtgacaatgaacctctttgtccactgaacactttgcaaaatacacttgtatgttgcacacgcacaacactttttttattatacatgggaaactgtttttgtcaatacttttcccgctggcacattctgcctcgtttcgcatgtttttacaatctcatttggttctatgcatatttttacactatgttttatttgttttttctactttttcttctattctgtgctgtttttctgtcatttttcattttttgatcccaattttttcatgactaaatatgcagttttctttttccatgtttttccacgcaaaaaatcccggaacggattttactctccgttccgggatttctctttcctgtataagtatgcatcacctgcagtcatacataccggtcagttcttatgatgttatgctgtctttgttgcgtacatgaagtacttcataccgaatatcgttgcgtagataccggttacgttagacttctgcatgtaaatatcattgtagtagtagatcggaactactgcccatgtatccatcagcatatcctctgcctgatgcattaagtcaacacgcgctgcaaaatctgttgtggtgcggatctgattgatcagctcatcatatgctgtccagtccggagaagaagataccggagtaccctttcctaactgcatatcgttgttaccggaatcagaggtaaagatctctaacatgttaaccgggtcgttgtaatctgcaagccatccctcacgcgcgatggtgaagttaccgctcttacgatcctcaaggaatacattccagtcctcagacttgatctcaaggttgataccaagtaatgcaacatcctgctgtacggactcagcaaccgcaatgtgtgctgtaccgtcgtttgttaagtatgtcatggagattgccggatctactgcgtatgtaccgtcaccgttgtctgtaaatgtatatccagcctcttccagtaagccctttgctgtctcaagctcgccggcaccggtagctgttgcatcatagtaagaagtatctgctgtcttgaatacgccgccgttaccgtctgccataccttccggtacgaaagaatcagccgggatctgacctgtctggcctacgttctcaacgatgaactgacggtcaaccagtaagctgattgcctcacgcatcttagcagcctcttcctctgtcttgccatcgaagaccgggtcgtttacgttgaagccgatgtaataggttcccaggttgtcaaggataccaaactctggattgacgccgtttaaggaaggaatctcatcgttcggtacggtatcgatgtagtcaaggtcaccgctgttgtatgcagcatagattgctgtatcatcagcgcttaacatgaagtgaagctcgtccatggttacgtttgccgcatcatagaagttcgggttctttacataaaccatgctctcgttgtggttccaggactccagtgtgtaagcaccgttgcatacaaaaccagcttcctgtgcccacttgccaggaacagtgccgtccgtatcagcagcctctacggatgcctgatgtactggatagaatgtcgggaatgccagtaagtcgttaaagtacgggcacgggctgacaagcttgatcacgagtgtgtaatcatccggtgtctcaactgccagtgtaccgtcatcgttgcggtcgattacatcgaacagataagcatagtctgctgctgtcttctcatcgatgacacgattccagctgtatacgaagtcagatgcctttaagtcatctccgttgctccacttggactcaatcatgtgaacagtgtactctgttccgtcctcagatacttccggcatatcggttgcgagtgccgggataagattaccatccttatcataggtataaagacctgcgaaagagtttactgcaaggcagccgccgtctacggagctgtttaatgcaggatcaaggtaatccggctcacttgccaggttgatgttgagcacatttgtctcagcgtttgtggttgttgcttctgcagttgctgcagcctctgtgccagcagcagttcctgtggactcgcctgtacttgctgtggaatcagatgatccgccacaagccgtaagaccaagtgccatagaagcaaccagtaatgatgctactaatttcttcataatgaatcctccttgttttccgaaggaaaatgcgactgtcacaacaggagcagaggattttcctcctataaaatgatctatgttccacgtaccttttcggtaacgttgaaaccttacttattccagcatgcaacgaagtgtccgctgcctctgtcggaaagcggcggcatctcttttgcgcactgctctgtcgcgtatttgcatctggtgcggaacggacatccggtcggcatcttcagagggctcggtacatctccctccagcacgatacgcttgctgtgtctggctgtctccggatccggaatcggaaccgctgacagtaagctcaatgtatacggatgcatcgggttgccgtttaactcatcggcatcggcgatctccatcatttttccaaggtacataaccgcaatacggtcggaaatgtggtgaacgaccagcagatcatgcgcgataaacagatacgccacgcccagcttgtcctgcagttcctcgaacatatttaccacctgcgcctgaatggacacatccagtgcggataccggctcgtcacagacgataaacttcgggtttaccgcgagtgctcttgcaataccgatacgctgtctctgtccgccggaaaactcatgtgcataacgcatggcatgctcggcattcagtccaaccagctccatgaggttcaagattttctcacggcgctcttttttattcgcatataatttatgaacatccagaggctctccgatgatgtcctcgaccgtcatacgcgggttcaaggatgaatacggatcctggaataccatctgcatctgtctgcggtaaggaagcatgtccacatccactttcttgccaagcaccggcttgccgtttgcatcgacgatcagcttgccattctcatcatactgttcgccgctgtcaaaaagcaccttaccatcgaacacgatgcgtccggcggtcggctggtacagacgaagcagcgttctgccgacggtcgtcttgccgcatcccgactctcctaccagaccaagtgtctcgcccggcttgattgcaaatgaaatatcatccaccgcttttagcggaatcgtcttaaatccctgatgcacaggaaaatactgttttaaatgacttacctcaagaaggttcttttcctcactcattactctgcctcctcctgtgcctcatataactctttgatgttcatccagcagcttgccagatgggtatcgctgatgcgaagttcttccggtttctcagaaagacagatcttcatcgccgcatcacaccgcgggcagaatgcacagccagccggcatctgcaacaggttgatcggtgtaccgccgatcggcaccagcttttcgttcatattgtctgccttcgggatggaacgaagcagtcccttggtatattcatgtgccggacggtagaaaatatcatccgctgtaccgcgctcgcagacacgtccgccgtacataacaagaatctcatcacacatacttgcaatgacgccgagatcatgggttaccatgataatcgccattccaagcttcttctgcagatcctgcatcagttccagaatctgtgcctgaatcgtcacatcaagtgccgttgtcggctcatctgcaatcaggatatccggctcacagacaagtgccatggcgatcatgacacgctgacgcataccaccggacagctcatgcggatactgcttcatacggctttccggctcattgacgccgaccagtgtcagcatctccaccgcgcgcgcccacgcctcttttttattcttatccgtgtgtaataatattgcctcaatcagctggcttccaacggtaaataccgggtttaagctggtcatcggatcctggaaaatgatggagcatttttctccgcggaacttctgcatctgcttgctgttccatttggtaatgtcctcaccgtggaatcttacctctccgccagtgatcttaccggtctccgccagaatctgcatgatggaatatgcggtaacggatttaccggaaccggactctcctacgattccgagggtctttcccggctctaagttaaaggaaataccattgacagcctttacctcacctgcatctgtaaagaaactggtatgaaggtcttttacttctaatatatatttattttcttcgctcatatccttatctccttaattcaatttcgagtcgaaagcatcacgaagaccatcacccagtaagttcaatgccagcacgatcaggcagatggcgattgcaggaatgaccaatctaagtgggtaggactgcatgccggctctggcatcgtttgccagacttcccagggaagtaagcggtgcagatacaccaaggccaaggaaactcagataactttcggtaaaaattgcactcggcacctgaagcgctgtcgtaataatgataacggacagacagttcggcaggatatgtctgcgcaggattctggcattctttgtaccgatgcatcttgctgccagaacgtactcgttgttcttaatggaaaggatctggcctcggatcagacgcgccatacttacccagtacagaagtccgaatacgataaacatggagatcatgttcgttcccagcttttccagcaccgttccggtaatgagcggttttaacgtctcattaaacactaccgacagcagaatgatgatcagcatgtccggcagggaataaataatatccacaatacgcatcatgatgaggtcgacttttccaccaaagtatcctgcgatggaaccgtaaagcaggccgatgatcaataccatgatcgatgccacaacgccgaccgacaggctgactctcgttccgtagatcacacggataaagtagtcacggcttaagctgtccgttccgaagatatgtggaaacagcttctcgccggtctcgttcatatactttgtctcaagcttggaatattcaaacggtccaaggttcgctgcggatttgtcacgcacaccgttgaccgagataatctcggaatacttgtaaggacatatatgcggtgcgatgatgatggtcagaagaatcaataccagtacgatgatacttcccatggcaagcggattcttgcgcaggcgtctcataccatccttgaaaaatgtggtagactcacccatgacatcctgctgctttttttcctcatctgtcgccttctcgaaatttgccttattgaatttgctcagatctacctgtgccgacagaatctgtctatgtttcaactccattacttctatccgtcctttcgtactttactcaaatgtgattcttggatcgacgaacttatatgcaatatcggtcagcaggtttgccacaaccatcagaattgcgaggaaaattgtcgttgccataatcatcgtatagtcacggttggtaatacttgttacgaaagacgatcccagtcctccgatagtaaaaatattctcaacaaccatggaacctgtcaaaatgtatgcaaccatcggtcccacgtaagtgattaccggaatcagcgcattgcgcagtgcatgtttgaaaatgactttccagcccggaacacccttcgctctcgcggtacggatgtaatcctggttcagggaatccagcatactggtctttgtcagacgtgtgatatacgccatcggataaacactcagcgcgatgatcggcagtacataattcggactcgtggacgaccataccgggaaccagccgagttttaagcagaacaccagaagaagcagtgttgcaagcacgaaggacggcatcgccgtaccaagtgttgtaaaaaatacgatcagccggtccggccagtgattacgcgtcaacgccgcaatgcttccaagtacaagcccagccacgattgccaccaatgcagccatgccgccaagctttgccgataccttaaaacgggaagaaatctcgccccagatatcacggccgctatgtaaagatacgccccagtcaccatgaagaagattgttcatataaatcacatactgctccgggattggtttgtccagattatatctctcttccaggactttctgtgcctccgcactcgttgccttttccttattgaaaggaccgcccgggataatgttcatcacaaagaatgtaatggcactgacgatcaggatggatacaatcgccagtaaaactcgttttacgatatactttcccactttttttctctcctgcttcttgaaaattctttctcattttatcgctctagcattgcgttcttttatctgtttgtatctctaatgcaatgtcacgttaacccgataaaataatataaatgtattatactcgctcactatcatttgtcaactgctaattgtatacaaaaatacatggatattacctcctttttctgtacgcccagtaaatacaagtgtttttcccacataaatactctgtctttttttttagaaatttgttatactttcttcaatcacactatctcttacagaaagaaggcagatccatcatgattcaaaatgatgatattctgaatatgaacttttataaaaaggaaaaatttaccggcagttatcagggaatgcgttacctcatccaaaaagatcaggaggaggatgccgaggacgaaaatgtaaaacatgatatttttcgcgtcaccatctggcccggtccttataattttgccagcaccgcggacgatctgaaaagttctgctgtctttccgtttacgccggagggcaaagagcaggtggtcgactggctgaacgaacagtggagtgcgcgccgcaccgaatggcccggccgttgaatcagtctctttctttatatgagcatctcgctgattcattatcactgcactgtaacacagcaccaaaaaaagccacatacgaagtatacatcttcgtacatggcttttcttattctattcctattcacggaaacgcccgtaaaacccgaaaacttcacgccgtattctgcgctctgtctcctgctctactgcgggtaacaggagcttgaaaaggttcaagtcctgtcttccacttttctcctgctctactgcgggtaacaggacttgaacctgcacggtctcccaccagaacctaaatctggcgcgtctgccaattccgccatacccgcttatcagagaaataactgcttcccttggaaagctaccggtatattatagcgtgctggcagacagattgcaacttctttttggatttaagcctccggcttctcatagcgtgtccacactttgtccgcgccgcatacattcttcgtgccgtcctgctgaacgataatataatcgccctcaccgataaaggtacgtcctctgcggtgcttgatgtacgggcacacgatcgtaccgtcgggccgctcaatctttacgagcgaatccgtcacgatccatcccttggtcacaacatcggaaaacagttcaaaaccatcttccatcccttttcccacttcgtatttgtctacttcggactctaacggaattcttcgactcttcataggtctcctccttttccggtgatgctccctgcttaccttccttatattctgaacactttcgtccgccgcatgaaaacgcgggcgtccgtcctggcaccatattcacttctgccttcgcctatattataccatactgtccgaaaatttacatgccttttttcgtactttcgcactattcccatgaaacaacaaaaatccccgtgatgccggaatatgacatcgtgaggattttcgctctatatgcctgccgtattccggcagcatttcttatttcttatttcttatctctttatgatctggcgatccgctccgcctgcgcccttcgcacaaaccggaatgcgccaatgctctcaagcgccttcgctgttgcaaagaagatgacggaatcaatcggccacataatcagattctttaatgcacgcgccggaaggatcaccatgaatgcctgtccatataacacggtgaggcacaatgtattcaggaacacattgcacaccagcatcacgataaacttggtggcaagcaccctcggcagtgtgagtttcttcttataatacatacagccgtacatgacgcctgccagcatcgtaaccagtgtcagctgcggacagaacggaccggtcggctttaagatgtatttaataatatcaagcgttccggaaaaaatgccgccaaccgtcggtccaaacaggtaggcaatgattccgttcgggatactcgaaaaaccgatgcggataaaattgccatattcgatggagaacatgccaagaataatggcgatggctgccagcatagccatggtagtgatggttcttaccgattttaattcacggtaggaatcggtgaacaaagcgacgaattttttcataaaaaaattacctcctttgcagacctcatcatactacaactggagataatattcctatcttcggatgcagcgggatgcgactcatgcaccgcaagaaactcttttcgtctggctgacaactccctgttcagccggcacttaacgcgcatgtgtctactctgcgaacaatatttacttgcaacggtaacagtataacataccttagcggtaatacaataggcaattctcactaagttttgttccaaagtcacaaaaagcggaaaacctttaccggctttccgctctccattccttagtgagacacgggggattcgaacccccgacaacctgattaaaagtcaggtgctctaccaactgagctagtatcccctatatcagattacaacaaaagcaagctgggctagcaggattcgaacctgcgaatgctggaatcaaaatccagtgccttaccgcttggcgatagcccaacaaataatcgttgcacctatcgcaactaaggtggatacagggattcgaaccctgggcctccagagccacaatctggcgcgctaaccaactgcgctatacccaccataaaatgtgctcgaagggattcgaacccccgacccacggcttagaaggccgttgctctatccagctgagctacgaacacatatgatcttgtataaacctgtcagtgcagatttaaagcgggtgatgggaatcgaacccacgtatccagcttggaaggctggtgttctaccattgaactacacccgcacgaaatcggggtgacaggattcgaacctgcgacctcctggtcccaaaccaggcgctctagccaagctgagccacaccccgaaggattttatcgcttgcgcactcttccggccactgagctgtccttttcgtgacgcaaggattattatataggacagcttctgaaaagtcaacacttttttataaatattttatttcaaaatttgcctttccgtttttgtccagatccatcacaatgtaggacggtcttctcccctcctgcctcggataggaaagactgcccggattgagcgcaatcacatcccttgtgtaatcgatcacaggcctgtgcgtgtgtccgaacatcacaatatcatagccctgtgccgccgcttcccgctcaatatcggcgatccccgcactgacatagtaataatgtccatgcgtgatcaatacacggtagctgccgatgcgaagttctttttcccgtggaagattggaaaaaaagtcattgttgcccgcaacgatctccagccggcagcccgccatctccgcaatactgtcctcatctccctccgcgtcacccagatggatcagaagatccatcggctgctcacgctctaagataacttttaaattttcaagtttcctgtgcgtatcgcttacaaccagtattttcataggctaaaacccgtactcatgcagcagcttcttcatggaacgaagtgcttttcctctgtggctgatctcattcttctgctcttctgtcagctccgccgtcgagcagtgatactcatccacatagaagatcggatcatatccaaatccattctcccctgccggacattccccgatatatccctcgatcgtctcccgtgtcacaagtgtcttcccgtccggaagcactgctgcaatcgcacagacaaaccgcgccgtgcgctgctccttcggcacgcccttcaaacggtcgagaatcgcctgattcttaatatcataggaggtatcctcgcccagataccgcgccgaatatacgcccggctccttgtttaaataatctacctccagaccggaatcgtcagccagcacaatatccttcgtacaggcagctactgccttcgccttgatctgcgcattctcctcgaacgtcgtgccgttctcctcaatatccagggaaatacctgcttccttcatggagcagatctccatatccatatccgccataatctcgcggatttctctcatttttccggcattgccggtggcaaaaattattctcatggctttgtcctctttttagtatccttcttcaaatgcgcgaagcactgcctgatagacgccctctgccgtctccatctgatatgcatcagaattcagcttttccaattcatctttgttcgtcataaatccgacttcaatcagtgcaaccggcacctcactggttctaatgatataaatactgtcgccttccaccagtcccttgtcacggcttccaatcctgcctgtgacttcctccagacagatctgcgcgaactggcggctcgcctccgacgtctcgtcgtacatcacctgcgtaccgctggtacctgacatgcgtccgcttctcgtcgagttattatgtatactgatgaaaagatccgcgtcagacttgttggcaagctgcactctctggtcaaacgtcggattgctgtcatccgtcctggtgtaatacacaccgatgttctcatcgctgttgtcaaaaatctccttcagcttcagcacgatcgccaggtcaatgtccttctcgttgattccctgcttgttcgcaccgacggctcttcctccgtgccccgcatcgattacgactactttatcatagacttcatgaggtgtcaaaaaattaaaataaaaagtctgagtgtcatattccgtctgcagttcatataccttgttggtcgtgacctctatcacgcccgtctccccctgcctggtgtaggagaggccgtcaatatagtcgctgttccccagaaccgggtagctgtcaaaatacgtgcggtccgcctgcggaatttccacccggatggtctgggtcacataatcgctgctgacagcaatctgatccccggtcacaccctccggcaggcgaatactcaattctccctttgcccccgccgcttcattctgctctttgatctttaagttctgcatcgtgacctgactctgggcgaactcttcctcagcaatgcgttcctctctcgcctccgcctcccacgtgtgaagcgccggaagctttggcagaagcacaaaagatacagctgtcagaatcatgagaaagacagccgacagtctcaatgctttttcttccataaccgtatattcctttatcgattcttactgaatgccttaatacagagattacattcctccaccgtatccacgctgtcccatctggcgccgttggtactgatataactctcgccatcgtccagaatcacatccgcagtcgcctcgtcggcagcgtattcgattgccatcggatgcaccgaccccggcgtaatcatgtgaagcacaatcgcataacgctcccccgcatccagtgaaattgcctgattaaaatcaaccgtataatagcccgcgttggagagtttgccggacgccaccggaatccgctgcgtcagcgaaccggcatcctcaaagttccttacaacgtacagctcgtactgggagtcttttcctatcgcgtaaaaaccggctgccaccagttcctcttcctgtgacgtcgtgtagacattggcgccgtaggcgctgtccttgttatagccaagctgtccgacccagccgcacagatcgctctgatagatatggtcatagttgcccggctcttcgatctttgtatacacaacgttgtgggtgcctatattcgtatcataatacgatatgtaaaacaccccgtcctcgccgaacgtatctccccagctgttctggcagataaatgcgccgtctccctcgagatccacattaaaattctccttggaataactgtcgtcccagccgataatcacaacgtcgtgattcggcttctctgtaccgatgtagcagtaggaatttgtcttctgattgtaatacggagactttgactgcgagctgcgcagcccgttatagatcgacgtctgcactccgccgtataaaaagaccgactccttgatcttctcataatcttttccgtcgatgatctgcatttcctgcacatgcttgaccgctgtaagatccggattcgttttattgtccccgtaagggtcatccgcttcgtatacaggtccttcccatgccgccagataagccattcccatggtatattccccgccgtcatcctgcgtcagtgtaaatccattgttcatcgtcatatggtcgaccgaaaactgcagtttctcttccggcagcaacgacgactccagtgcccccagcgcggcaaacgcccagcaggtgccgaaagttccctgattgcgcactgctgccgcccgtcccttctccctcagatcatagcgggtcggtatgattgtcgcactgtccgacgtgtccatcgccgacgcctgattctcctgtatatcccaggaataggaataatccagataattcgccagatcattcaggcttacatagtaggtatcgtccttgcggataaacggcgacacgatcacctcacgggttccgttgactttcgcctccgaggcgcccagtgaaaactccacctcattcgcatgcttctccacaaggagccgctttccgtcatacacatgcgcgctgcagttgagtgcatcgcgcagaatgttcaccggaaccatgatattcagctggtcatccatataaaacgtatggttctcgttggtgtattccttgttatcgatcaccagcgacaacagattatcatttacgctggatgcgatcaacgggttccaggttgccgcctgcagattggctccgcggaaattttccaccgttccgctccccgatgcccccggttctaatttaaaaatcagcatggcggctaccagcacgccaaacacgatatatctttttgaatatttcattcatcccctccggcggtatcccttacgctccgccttggtggcttcggccccataaactggtaaaaataggtgcgaagcattccattgtagatcttgcggttcttgtccgcttttctgccgatatagcgctccgcttcatcataactcgtaatcagatacatcgaccaggaatcgagtccccggaatgccgccccgatctccccgtacagcttcggcagatccgccttgtcctcgaggcgctcgccgtacggcggattcgtcacgataaagccgtatttcttcgggtggtggagttccgctaccgggcgctgctgaaaatgaatcaggtgatccacgccggcgcgttttgcattctccctggctgcctttatgacgtccccgtcaatatcatagccctgtatgtcgaccttcacatccgtgtggatcatctcctcggcttcctttacgcactcgtaccacagcttgcggtcaatcaggttcgtccattgctccgccgtgaactcacggttcattccgggcgcaataccggcagcaatcatcgccgcctctatcgggaacgtaccgctgccgcagaacggatccaccagaatccggtccggtctccacggcgtcaacagcagcagggaagctgccagcgtctcggtcagaggcgccttgctcgtcaatgtgcggtatccgcgcttgtgcagggagtccccggacgtatccagcgtcaccataacctcatccttcagcagaaagatgcgcaccggatacggcgccccgtcctccgcgaaccattccacatcatagtgctgcttcatgcgctccaccatcgccttcttcgcgatcgactgaatatcagacggagaaaacagcttgctcttgatagaagacgccttttttacccagaactttccgttcacagggatatagtcctcccacggaagcgccttgattccctgaaataattcctcaaaggtcgttgcgcggaatctgcccacttcgatcagcacgcgttctgccgtgcgcagaaagatattggcacggcagacagcttccgcatccccctgaaatgagactctgccatcctccacccggctgatctcatatcccaggtcatagatttctctcttaagtaccgcttccagtccaaaatgacatggaaccaccagttcatatgtcttcatgtattctcctctgtatcatatgtctaatttcctaataatatattatccattctaattttccctgtcaatcacttgttcgcattgcctcaatgccgccaaccacggtatatacctcatacccctccctgccgagctttctcgccgccagaagactggtgcttccataatcgcagtagagcaccagcggtctgttcttcggcagacggtgcatccactgatcgatcttttcatacggaagatttctggcgttcggataatggtattcccgataagaatccgcctcccgcacatcaatcagaattccgtgctttcttctcataatatcttccaattcccttggatgtatcgtataaaacgtcatgcccgcgtatcctccttttccgccatatgctcctgtaatcgcaaaaacagattacaaagaggttctctgtaatctgtttctgtcaatcttattctatcctatgcgctttttctctgcctgtgccagtctactgctgatacttgtcagaggtcttgttggaaccggacacgttggatgtcttgttggttgacttgttggtcgacttattctttgcgctgttggaaccgcttcccgcgttgttctcgtagctgttctcataaccgtctctgcaattagaagtcgaattctgtgtactttcgttttttgccatgttgccctccatcccggcacgtgctcgtgccgaatctttttatttgcttactgcatggttagtatctgatgttccccggaaaatatacatggcttttgtggttttgcattgctttttcaaaaagaatgttctatactaatgctgtgatatgtaaaacatatcattttataccccttattaattatttatactcccctcagaaaaagccaagtgcatcgcacctggctttttctatcttatcacagttcatatcttatcacagttcataatattcgagattgtcggtaagctcctgcgtgatcctgcctccggctttctgatacttgtcatagactccctggatacgctgcacggtcttcgcgttcaaaagatcgaggcggtgcagagcgctctcatacatcggattcccctttaactcctcccggatcggctttgcgaacgggcaataggtaatcaggatctctcttgcgatcttgttgaggcggtagcttcccttcgactcatacttcatccagttctggtaatccttgacgaagacctcacggtaattatttcttccacgcaagagcgcactcttgatcttctccttcgcctcggcggaaagttcgcggttcttccggtagaactgcagataatcgcaatactccgccgtcagggacttctcacggatatcgttccagtgtacaccctgaatcttcctgcagatctcccagcggtatcttccgaccgtatcgaccatcatatcgtcaatatcgaccgctgtaaaaatcgggaacaggaaacgcgccgaggtatctcttcgcacgcctgctgtctcctgccacatcatcgagcgtgttcctgcattcggcatcagaatgatgtccggcatgatctccttcataatcatctcgcggttgatgcccttgtccggatccgagaactgcacttcacgatagaacgcggagaaatcgatgtcgcggatcttgtgcagtgactcgtccagcttctgcgccgtcacgagcatcttttcaatggagttgatcagatcatactcccctaaaatcgggcagaacgtggacagcttgccataggtcgcacggtttccggacgtgaacatgttctgaatctcaaacttgactttgagctcccggttggacataaaatgcttctgctgctctgtcgtaatcttgccggtcttgcgcatctctgcaagatatgccggataatccatatcgaactcatttttcgacggctcgtttcttccgtcataaacactgcgcagccattcaaaaatcgtgtatacatggtcagatttgcagacatccagatgctccgtgagatcgaacagaatattggcattctcctcgccggccatctgcacatccataaatccgaaattcaaaaacatttccacaatcggggtaagctctttttccccctttacggtatgcataaacgcttttaagtaggtatcgtagaaaatctgtgtgatccgcttgcggattgcaaacgtctgcgcgtccgtggaaaacatatccggcagatcccggtacttctgcacaagctcctgcatctcctcaatgacgctctgctcggtatccgcataggtcaggatatgaaccaggcagtcttcactgcgctcttcctgcggttcttcctcctcgccatcctgtgcctgcggcgtctcatacgctgcaccttctgtctcgaaatggtatccacggtattcttccatccgcatgtcgaccagctttccgctgtagatgccaagctttttgattacctcggcaatccggtccatctcatttaaaagcggctttacatcataatttttcttctgcgcctgaatcgccagagcaaagaacaggttaaaaagatcgtttttcgattccgccagaagaatatcctgattgtagcggagatattccaccatctcaatgattccctgcgtcacacgcctggtctgataactggcttccatgatcgccccgatgcagagattatcgtcccgctgcatcagatgcacatactcctctaaataacttccggtcaggctggcactgttgcctatctcccagttctccgcccggtgcaccatctccaacggcttgaaattgtccatgcgcgtaaaactctgctcgtccagatggtactgtgcgcagagattctcatactggctgtactcattctcggcaaaggagtgaaactgccttaccagattggtaaaaccggcataggttctaagaagcatctgccgctgtccgagtgctgcccgaagcagaatactgcgcatgctctcctgcccgtgaatcgcctcctttaaatcctccgccgattcacaattgaacaccgccagcacggaatcctcggtcgcaacataatcacacagatatctgtcgccctcagaaattccaatcaccgcattttttccaagaacaatcttggcgtaggaattgcactgaatgacagtaccctcctgcacgatataccatttttttactttctctttctgcttggcaattatctggttcttctgtacctttactgtcgtcatcgtctctctgtcccctgcctgcgcacatgaccgtgtgtctactgccccttcgcgcgtcctttacttattattaacaattccgtaagcagctcgtccgctgcctcctctttactcatccgtgccagttcccgctcgccgtcctctgtgatcagtgtcagcacgttcgtatcggttccgaaaccggcgccttccaccttcagattattggctgcgatcagatccacattctttttgcgaagcttttttcttgaattctcaagcatgtgctccgtctccatggaaaacccgcacagtatcgtctttcctttgtccgcccctagagctgccagtatatcctgtgtgcgttccagttcgatcgaagcttcccgatcggacttcttgatcttctcctccgccacagatgccggtctgtaatccgccaccgctgccgccttgacaataatatcctgctcctttgcacggctcatgaccgcgtcatacatctgtgccgccgtcacaaccggaacaacattcacaaaccgcggcggctcgcacgctgtcggtccggtcacaagtgtcacatccgcccctcggtacatggcgcgtctcgcaatcgcatatcccatcttccctgtggagtgattggtaatatagcgcaccgggtcaatcgcttcctgtgtcggacctgcagtgacaagaatttttaatcctgccatgtcctttggcgcagcaagttctcttaagacatactcggccagctcttcctcggacggcagtttgccgtctcccgtatcgccgttcgccagcatcccccgcaccggttcaatcatctcatagccgtaatgctccagcttgcggatattgtcctgcacaatcggattgtggtacatattatggttcattgccggggcgatcaggcacttgcaggtacacgccatcaccgtcgttgtgagcatgtcgtctgcaattccgttcgcaatcttgccgatcacgtttgctgtagccggtgcaatcagcaccagatccgcctgtttcgcaagcgccacatgctccaccgagaactcaaaattccggtcgaacgtgtcaatcagacacttgttcgccgtcagcgtctcaaacgtcgtcgctgtgataaaattcgtggcattctgcgtcatcagaacatgtacgttgcacccaagcttcttcaacatgcgcgctacattcggcatcttataagcggcaattcctcccgtcacacaaaggagtacggttttcccgctcaaaagtccccttggcttttcgctctgcttattcattttttcctcctgctctcgttcacttatcccatgatacgatgctaaaattccatttttattctatactcttttccctctctgtgcaatgcctttctgcctgcgcgcccaactttcaccgctaaatgtaacgcggcatttcctgaaaaaagaatcctattacataaaaaacgcacagaccgtgtcacgtgacacaacctgtgcgcaaataaatatgttccctatacaaccgcccggatgtaatgctttacctcgcgcagctttttcacaaactggttgtccagctcatagaatccaaggccaagcggaaccgtaaccagaatgttaaacgggacagcaatataccatgccgtctgcatgatcgcgccgcccagttcaaagtgatagtataccatctgaatcaggaagatatgataggaagcttttccaatctgtgtgagcagtctccccgcaaatcccggaatcgtacagtgataaaatttccggaacaataaaataacgatcgggaaaatatagaacgcaaccggcatcgctgtcgtcttccagtagccaaacaactcgaaatccttgtcgaatccgaaaactgcaatcagatatgccagtcctgccagaaacatcatccacatctgatacggctttaccctctgctccggatgcagatacagataacagccaaacgcgattaagagcaggtatcttccgatgctcaggcggtaataatatttatccatatcaaacacgatgacgcacacctcaaacgcgagattggcgagcgctgccacagcaagtccaagcttagcattgtatgcgatcatcacataaatcaacggaaaaataacaagcagctgcagcatgatcggtacataatagcttccaggtccgtatgcgccaagcacaaaaatacggaacaacggtatatttttatcctgcgctgccagcaacagaatctcaagcagacaaatggcaaaaaacggcagcaaaaagcggatcagctttggtttcatcatattccagccatacattttctccagatttccgtctgcttttttgcggtttgacattgcaaaattataaccgctcacaatcataaataccggcactgccatgttgatcagcatcgtaaaaaaaggagatgtcttatcctcccatccatagtgcgtaatgattaccataatgacacagactgccttgagataatccagaaattcgattctctgtttctttccctcttgcatttctaatcctcattcctctttttatacacaatcctgatgtcctctttttgacaccaattctgtatattacgcactttttgcatgattttcaatagtaattgtggctaaatttgggcttcaatcgagggatttataaagcatttctacgatatgattttcagataaatcaaaagatatatactatagaggaaaaaaagacccggaagatgatcttccgggctttcctacgtgcgcgagaggattcgaacccccgacaccttggtccgtagccaagtgctctatccagctgagctacgcacacatattcttttttacatatctattatagcactcttgtcaagtagctggatatgaatgccggcgaccggaatcgaaccggtactgtgtcaccacaacaggattttaagtcctgcgcgtctgccagttccgccacgccggcattactgtaacagttgttacagaagtgggacctatagggctcgaacctatgaccctctgcttgtaaggcagatgctctcccagctgagctaagatcccatatgaaattatcataagaacaattttgctctcatgagcgacccaagcgggactcgaacccgcgacctccgccgtgacagggcggcgctctaaccaactgagccattaggccagacatcttacaaacgcttttgtgacaagtggaccatcggggactcgaacccaggaccgaccggttatgagccggttgctctaaccaactgagctaatggtccaagtagattacttctataagccgatgatcggactcgaaccgataacctgctgattacaaatcagctgctctgccaattgagccacatcggcatatttacctcagctgattacagccagccaaaagctagtgactccaacgggaatcgaacccgtgttaccgccgtgaaagggcgatgtcttaaccgcttgaccatggagccaggtagttttacaaatacacttctacagtcaaaaaaaactccccgagtaggactcgaacctacgacagcgcggttaacagccgcgtgctctaccgactgagctatcgaggaatattagctgatacacagcttccggtaaaacctatcataaataagttgtaccttcaaaacttcacacagaatccatccatcaaacctgcaaacattattcgttatatttggtcaagccctcgatcgattagtaacagtcagctccacacgttaccgtgcttccacctctgccctatctaccttgtagtcttcaagggatcttactcacttatgtgagggatatctcatcttgaggggggcttcacgcttagatgccttcagcgtttatcccttccggacttggctactctgccatgccgttggtcgacagcagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctagtttcctacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctggcattgtcccaccgccggatcacggcggctggttagaaatccaatactgcaagggtggtatcccaacagcgactcccttgaaactggcgtcccaagttcttagtctcccacctatcctgtacatgcagtaccgaatcccagtaccaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttgcgctaacctctcctcttaaccttccagcaccgggcaggcgtcagcccatatacttcacctttcggtttcgcatagacctgtgtttttgctaaacagttgcttgagcctattctctgcggcctgcgttagcaggcaccccttctcccgaagttacggggtcattttgccgagttccttaacaatgcttcttccgccggccttaggattctctcctcatccacctgtgtcggtttacggtacgggcacacatgaaacaatagcggcttttctcggcacatggctcacacgcttcgctactctaattcgctccacatcacgtcttcggattgtctggcggatttgccaaccagactccttctccgcttgtaccggtatttccattcccggctcgtgctctccacatgcgtccccacagttctgttcatatgtggtacaggaatctaaacctgttgtccatcggatacgtctttcgacctctccttaggccccgacttacccagagcagatcagctttactctggaaaccttggatattcggccgagaggattctcacctctctctcgctactcattccggcattctctcttcttatccctccactgctccttccggtacagcttcgtcggtcttaagaatgctcctctaccaatcacttacgtgattccacagcttcggtgttgtgttttagccccggacattttcggcgcaggacctctcgactagtgagctgttacgcactctttgaatgtatggctgcttctgagccaacatcctagttgtctttgaaatcccacatccttttccacttaacacacactttgggaccttagctggtggtctgggctctttcccttttgactgcccaacttatctcgtgcagtctgactcccattcatcatctacatggcattcggagtttgatattctttggtaagctttgacgcccccgcggaaattcagtgctctacctccataagactaaaatgaggctagccctaaagctatttcgaggagaaccagctatctccgggttcgattggaatttctcccctacccacacctcatcgccacccttttcaacggatgtgcgttcggtcctccattgccttttacggcaacttcaacctggacatgggtagatcacccggtttcgggtctacggatactgacttgacgccctattcagacttggtttcccttcggctccacaccttaagtgcttaaccttgccggtacccgtaactcgccggaccgttctacaaaaagtacgcggttgtgcatataaagcacttccacagcttgtaaacacagggtttcaggttctctttcactcccctcccggggtccttttcacctttccttcacagtactatgcgctatcggtcactaaggagtatttaggcttacggggtggtccccgctcattccatcaaggtttctcgtgtctcgatgtactctggataccgccatgtcatctttcctttcgcttacggggctttcaccctctctggcaggctttcccaaaacctttctgctaggattgacgaatcaattatgcggtccgaaccccggaatgcacgcattccggtttggcctctttccatttcgctcgccgctactttggaaatcgatgtttctttctcttcctccggctacttagatgtttcagttcaccgggttcccctccatacgttatggattggcgtatggatacatgagatatgctcatgtgggtttccccattcagacatctacggatcaaaggatatttgctcctccccgtagcttttcgcagcttatcacgtctttcatcggctcttagtgccaaggcatccaccctgcgctcttttttgcttgacctcgtttacagtttctatagcgttagaaactgggtctttgcgtttaataacgcggatcgaattgcttcgatcttgaactttcgttcgtttggtttggtcgtaaactttgtttacgatattctcggatgtcttgataaaaaatcattttcatcaaaatcttctgtatgaagttttcaaggtacaatagcatttcgcgcaatggcgctcatgcattagaaattgctttgcaatttccgtcaagcggaatgttttgcaatttcaatggagatggtgagattcgaactcatgaccccctgcttgcaaggcaggtgctctcccaactgagctacacccccattcatgcagttttctgcatgactaaatgggcttaagtggactcgaaccaccgacctcacgcttatcaggcgtgcgctctaaccggctgagctataagcccatttgaaatctggcagccacctgctttcccataccgtcgccagtatagtatcatcggccgcttaggtcttaaccatcgtgttcgggatgtggacgggtgtttcccctaagcgcatcgccaccagaaatttgtggctatcaatatttgattgttattgataactcaacagtgaacaaactctctacttgatttccttagaaaggaggtgatccagccgcaccttccgatacggctaccttgttacgacttcaccccagttatcagtcctgccttcggcagctccctccttgcggttgggtcactgacttcgggcattaccaactcccatggtgtgacgggcggtgtgtacaagacccgggaacgtattcaccgcgacattctgattcgcgattactagcgattccagcttcgtgtagtcgagttgcagactacagtccgaactgagacgttatttttgagatttgctccccctcgcgggattgcttccctttgtttacgccattgtagcacgtgtgtagcccaagtcataaggggcatgatgatttgacgtcatccccaccttcctccaggttatccctggcagtctccctagagtgcccggccaaaccgctggctactaagaataggggttgcgctcgttgcgggacttaacccaacatctcacgacacgagctgacgacaaccatgcaccacctgtcaccactgctccgaagagaaagtacattacatactctgtcagtgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagtaatcgtccagtaagccgccttcgccactggtgttcctcctaatatctacgcatttcaccgctacactaggaattccacttacccctccgacactctagtccgacagtttccaatgcagtaccggggttgagccccgggatttcacatcagacttgccgtaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtgggccgttaccccgccaactggctaatcagacgcgggtccatctcataccaccggagtttttcacactggatcatgcaatcctgtgcgcttatgcggtattagcagtcgtttccaactgttatccccctgtatgaggcaggttacccacgcgttactcacccgtccgccactcagtcacaaaaacttcattccgaagaaatcaattaaagtgcttcgttcgacttgcatgtgttaagcacgccgccagcgttcatcctgagccaggatcaaactctcatgttatagtttgtttccttttccagaatcatctggcttattcagatgttactctgaatttactgttttaggttgttctttataagaacgttcgtctgtctttcaatctcttgatcgacagcttgaaatttaggatctttcaaggtttattcactgttcagttatcaatgtacatcgtcaatacttcgtattgactttagaagttgttctgcaacttctgagtggattttccagcctcactcactgttgtcatctctcggcgacagcttatttactatatcataccgtcaaccgtttgtcaacaacttttttgtttttctttcgcttctttcgaagcggtcgttcgcgtttcgtttccgattcgcaatcagcttgattagtatatctcgtgtcgactgttttgtcaacaacttttttcgactttttttgaattgtttcaacaactcagaaaatatgtctatcaagcgagcggagaaggagggatttgaaccctcgcgccgctattaacgacctgcaccctttccaggggtgtcccttcggccagcttgggtacttctccgaataaaataatgatataaaattgtatcagcacttctgttaccggagtcggtatcgtctgtgttgataagcggagaggatgggattcgaacccatgcgccctttcggacaaacggttttcaagaccgcctcgttatgaccacttcgatacctctccgtgttcttgtctcaaatcagtgcagaaataatattaccatctgcttccaccaatgtcaacactttttttcactttttctatttaagtataattccgctgccataatgtcttcaggcgtcgtgatttttaggttctgataacttccctcaatcacacgaacctgctctccaaatgcagtctccagcatcatcgcatcatctgtgacggcagaatctccctgtgccatcaccttctcatacgccttccggatccgtccgtagggaaatgtctgcggggtctgaacctgccacaggctgctccgctcgggcgtctcttttgcaaagccatccgccccgaccactttgatcgtgtcctttactggcattcccaccacgcaggaatccccctctctgacgcacgctatggaccggctgatgatatcggcggtaacaagcggtctcgccccgtcatggatcagcacgtaatcgctcccgtccgccgccttaagcccttcatacacagaatggtagcgttcccgtccgccttccacgaccgcacagaccttttggatatgatatttttcaacaatctcttttctgcagtaatcgatctctcctgcccccactacgacgacaatgtcggttaccgcgctctctgcaaacgcctgcagcgcataaaaaagcaccgggcggccggcaagcatcatatactgcttgtgcacatcactgtgcatccgttttcccgccccggctgcaagtaccactgctgttattttttccactatcgctcccccagcttcagattcgggaccgcattcagatccagtccgtccctctgaccgcgcatgaaatcataatatgccgccacaccgatcatcgccgcattatcggtgcagaaaatcggcgacggatgataaaatgccacgcccttcttctcgcacgccgcacgcattccctcacgcagggtgccgttggacgcaactccacccgcaatcgcaaatttgtccattccgaattcatcaatcgctttcatggcatttccgatcagcacgtccgtcaccgctttctggaaggacgccgcaatatccgcctgtacgatcggaatgttcttcattttacaaccgtttaaatagttgagcaccgcagacttcaagccgctgaagctgaagtcatacgggccgtccacgattttggcgtgcgggaactctaccgcatgcggattcccctcatgcgccactttttcaatcttcggtccacccggatagccgagtccaatggcacgcgccactttgtcaaaagcctctcccgccgcgtcgtccctcgtttttccaaggatctcgtattttccataatcaagcaccttgacaagatgtgtatgtccgccggacaccaccaggcatagaaaaggcggctccagatctttgttctctatgtaattggcgctgatgtgcccctcgatatgatgcacacccaccagtggcagctttttggcatagctgatggcttttgcctccgccactccgacaagcagtgctccaacaagccccgggccgtaggtgacaccgatcgcatccatatcatccagcgtcatccccgcatccgaaagtgcctgtccaatcacctgattgattttttcaatgtgtttgcgcgaggcaatctccggaacgacgccgccatacaaggtatgcaatgcaatctgggaggatatcacatttgatctgacatcccttccattcacgacaaccgctgctgccgtctcatcgcacgagctttcaatcgccaatatttttatctcattactgttcatcggaagaatctccctccacctgatagaataccagaatcttccagtctccatcgtcatcttttctcaaaacatacatttcgttggtacggtcgaagctgttgttctcattcataaaataagacgccgtcacataagcgcactctctcccgtccaccgtctgatacaccacatcattgctgtcgcagacattgctgctgcgaatcgtttttgatttgttgtggtaatcttcaatatccgctttcaggtcggaaagatactgatcccgcggattgttctccaacagttcgtcgtccagcagctttctcgcctgatccgccagcgactccagttcatcgtccgtataggtatcatcatagaagcactccagaatacggttgtaatacttcacaacctcacgcggagttgccggatagttggcatccagattctttgtgataagcttttgtatctctgtcaactccactgtatcttccaccgatgtccgtctctgtgtcgtaaaaaagtaatacgctcccacgatcagtaaaatgatcagtattgttatcactgccttaatcacgccactcttcttcattatgacaacctcccttttctttagttctcatcctcaaacatcaattccacgcttttcccgtcttttcccaaaaacgcatccgggaaaatctctcgcacctggggcagatagttctctgcatgcaccagggatggagaatagtgggtcagccacatttccctgacgccggctctcttcgccatgtctgccgcctcatagaatgtcatgtgtttgtactgcttcgccttgacaagcttctccggctccgcatacattccctcgcagataaaaaggtccgatccctccgccgccgccacgattgattctgtcggtctggtgtccgtgcagtacgtcatcttgatgccgcgtctggctggtccgagcaccatctccggcgtatagaccgttccgtcttccccggacaggatctctcccttctgcagacggctccagtatttctgcggaattgccgccgcacgcgctctctccacgtcaaacttccctgcacgttttatttcgaccgaataaccgtaacaggtaacattatgattgacacgaaatgcatgtatacagtatccattgagttccagccgcatttccggttccgtaatctcaataaaacgtatttcaaacggaagttccggagcaatcacccggagcgcgttcaccacccgttccagcccccgcggaccgatcatggtcagtggctcggttctgtccgcatttcccatggtgagaagcagtcccggcagtccgccgatgtgatctccgtggtaatgggtaaaacagatgacatcaatgggcttaaacgtcagtcccttttccttgatcgccacctgtgttccctcgccgcaatcaatcagcagactgctgccgttgtaacgcagcatagccgccgtcagaaaacggcggggcagcggcatcattcctcctgttcccaataggcatacatctaacatgaataaactcctttatcgctatatcagttctgtcttttgttccacctccggcgcgatggcaaacgtccgcacccaggcgtcataacacgattcgcacagatccatcctgtgcaccgtaccgtcttttcgttcggaaaaatagccccactctttacaaatagtaagaaaggaactttttcctgcttccccttccgtacagatcgggctgccacatcggttacaataaatcactccgtttcgtctgctcattgatatattctccattctatcgtctgtttcgcgccgctttctgcgcatccgaaattccttaggaacttctaatatgaatccgtcaggattcattatatcattgagccgccgtgcaatcccacagggaattacagggcacagaccataattctggcatcttctctcgggaattcataaaacccccggcggatacccaccgaggaaaatccctgcttctcgtacaaacggatcgccccctcatttgacacgcgcacttcaaggacaatgcgggcaatcttgtggtctgcggcacgttttttcatctctgtgagcagcccttccccgattccacgcctgcggcacgcaggattcacagccacatttgtgatctcaccctcatcggccgcaagatacattccgatgtacccctgtatgacacccgattcctctgccaccagaaagatcgtgtcgggcagacaaagcgaatccaaaaaagcattctcactccacggctgcgaaaaaatctccgcctccagagacgccaccttcgccgcatcttccgctgtcatgctccggataatactcatacgttttcctttccttttgcggcttcctgctccttgcgctctctttccgcctgggacagccggagatattccgggcggtgttccgccgcgctctccgtttttccctctctgtaatactgcatgccaagcacagcaaccgcgccggcccgctgcttgttcagatgtgcgggcgcataggaatgcggcaccgtaagctgctcctccagatatgccttaaaaaccggtacaccgtctcccaaaaatacgaccgcctcacctctgctgttgatgtccgccgcaatctcatcgattcccacggcacactctccgcgcagcacctgcatgtcgtttccatcaaaacggtacaaaccggtataggtctgatttcttcttgcgtccataagcgggcataccatatcccggtgtcccaccagattgtatgcaagtgcgtccaccgtcggcacattgaggatcggcttctccaacgcgagtcccagaccttttgccgtcgccgaaccaatccgaagtcccgtaaatgagcccggtccgcctgcaaccgcgattgcatcgatactcgaaagatccagttcgatcatgcgcgccacctcatccagcatgggaagaagggtctgtgaatgtgtctttttatagtttacggtatattctcccagaaggttgtcatcctccgcgattgcaacgctcgccaccagaccggaactgtccaatcctaatattttcattttctgtcctcctgatgctctcttatggtaattctgcgataatcaaatcccatttccagatctttttctatagtaacttcgctgcgccgctccggcaaaatctcttcgatcagattcgcccactcgatcatgcacagaccatccccgtagaaataatcctcgtagccgatctcatccatctcctcgatgtccccgatgcggtaaacgtcgaaatgataaaacggcatcctgccctcctcatatacctgcacgattgtaaaggtcgggctggagactggctccgtgatgccaagtccttccgcaattccctgtgtgaagactgtctttccgacgcccagatctcccaccagcgtatagacgtcgccgggctttgcctccgcgcccaggcgttttccaagcgcgtgcgtctcttccggcgaatatgtttcatagatcttttctgtcatattttaaaatccccattctctacttcatcttcaaacggtacgccggcagatgtgccgcagcctgtgtctgcagtgccgcgtagctttcccccagctgtgctctcggaatgacataggcattgatcctgctgctgtacaccagaacgttgtgcttcgtcgcgaccattttatagatctgctcccacggaagcagcgcactctcttccttctgcgatacgtgcagcccctcctcgtccacctcatagtgcagcgttccccgcagcacctcggacattgccagtgtgcgcttcgaccttaggtacaggctcaccggaggatagaccagaaatacgatgccaaatacaatatataatgcggtgtatgccgcctcgatcttcccgcgggtcactcctgccaccacaaaaatcaggatggaaaacgcaatggaaaaccacccgtgaaatccggagtaggtctggtacatattaaaccggtacatatcttctgctgtcaatgtaatatcaaactttagcggcataacatttcctcctgtctatatctaagctagtatagcatttttcattccaaaagaaaaggggctgtcgtctaagacagccccttttctagcggttcgctcctttcagaatcggcgaaatgtgtttgtataccaagaatgtgattaccacggaaaacagtcccttcacgatggtaaacggcatattgaagcacaccaggcactgcagaatgctcttcatggatggtacgatcacctgataagcgccgagcacagcttcttccggcataaagttgtagtataccggatataccaggaagtagttggataccacggaaaatacacccatgatcaccgcaccgaacagggatccaatcaatgcgcttctgcggctctttttgtggcggtaaatcaatcctgccggaagtacgaatgctacgcccagaaggaagttggaaagctcaccgacgccgccggttgttgtaataaacagatgaagcacattcttgatcagacagatcagaatgccgcataccggtcccatggaaaatgcaccgatcagtgccgggagctctgagagatccatcttgatgaaagccggcataaacggaacggaaaaatccaggaacattaaaataaatgctactgcggaaagcattgccgtgacgctcatgtagcgaacgctcgaaatactgtttattgttgtcctacctgtgattgtactgtttgtgtccataatgactcgtctccttttctctgcaggaattcgaggtattctcgcgtgtcagccgtctttcaacggattgcattccggcagcggaacagcgcttattcccgccacacaaaaagccccggatgatctctacatccggggcgttaaattgcattcttaagaccctgctgccgcaggtcctcctaacatgcttctcttctctcatccagactatactgtcggtcccggattcacaccggctcaactgcaactgcagctcacggactgatctggcgtctgccagaatcaccgtcggtcgggaatctatgcttccatctctgtgaactcatatcaccctgccccgaagaattcctaatatttattttgcttctatattgtatgcccatatgggcatactgtcaaccctttttctctatccgttcagcttcatcgtcagctggatgcgctgctttttcggatcaacgcttaatactttcacttccacaatatccccgacgctgacaacttcgagcgggtgcttgataaacttgtcgctcatctgtgaaatatgcaccagtccgtcctgatgaacaccaatatcgacaaacgcgccaaaatcaatgacgttgcgcacggttcctttcagaatcatccccggcgtcaggtctttgatctcaagcacatcgctgcgcagaatcggctttggcatgtcctctctcgggtctctcgccggcttctccagctccttgacgatgtcctgcagcgtcatctctcccacacccagttcttccgagagttttttgtagtcatggatctttttggaaatgccctctaccttccgctcttttacgtcagataacgtataatccagccgcttcagaagcttcttcgtggcatcatagctctccgggtgcacaccggtcgcatcgagcggattctttccgtcaccgatccgcaggaatcctgcgcactgttcatacgccttcggtcccagcttcggcaccttcaaaagtcctgcacgggatacaaatctgccgttttcctcgcggtaggttacaatattttttgccagcgtcttgctgatgccggagacgtattccagaagcgatgccgatgcagtgttcaaatccacgccgactttgttcacgcaatcctcgaccacgccgccaagtgcttcgcccagctttttctggttcatgtcatgctgatactgtcccacaccgatggacttcggatcgattttaacaagctccgccaacggatcctgcagacggcgcgccatggacgctgcgcttcgctgtcccacgtcaaaattcgggaattcctccgtggcaagcttgctggcagaatagactgacgcgcccgcctcattgacaataatgtactgtacttttaccggaagttcctttaacaggtccacaatgatctgttcggattcccgcgatgccgttccgtttccaagggaaatcagggtaatgtgatatttggcaatcaatttctttaataccgcttttgcctccgccactttattctgcggagccgtcggataaatcaccgtcgtatcaagcacttttccggtcggatctaccacagcaagcttacagcctgtccgaaacgccgggtcccatccgagcaccacctgtccggcaatcggcggctgcatcagcagctgctctaagttctttccgaatacacggatggcgccgtcctccgcacgctcggtcaggttactccggatctcacgctcgatcgccggtgcaatcagacggtcataggcgtctctcaccacatcgcgcagcacctcattcgtctgcgggttgtcccggacaatcacctttttctccagatagcgcagaatgtcctcctgcggcgcttcgatcttcacggtgaggaatttttctttttctccgcggttcaccgccagaatccggtgtccggcaagctttgccaccggctcgtcaaaatcgtaatacatctcatagacggactccgtctccgggtctttggcagtagaggtcatccggccttttttcaccgtgaggtcacggatgtgcgtacggtaatccgcctcgtcagagatggactccgcaataatatccgacgctcccgcaatcgcctcctcggcggttgtaactcccttttcggcatccacgtattttgcctcctcttctatgagcggcgtttttatcatctgcagtgtaatcacaccggcaagcggttccagtcccttttccttggcgatcgtggcgcgcgttctgcgcttcggcttgtacgggcggtataaatcctccagcagaaccatcgtctccgccgaaaggatctgcgctttcagttcgtccgtcagcttcccctgctcctcaatgctggcgaacaccgtctccttgcgctcctccagtcctcttaaataggtaaggcgctccgacaggttacgaagcacctcatcgtttaatgcgccggtcgcctccttccggtaacgcgcaataaaaggaatggtattgccttcatcgatcagcttgactgctgcctctgtctgatggcgcttaattcccagttcctcagaaatttttgcaataatatccatatctgtcctccaaattttaccgagtctgctcccagtataccgaaaatccgctgtaatctcaagtgccttcctcattgtctttttggctttcccatgttacaatagacaaagttatcctgcgatatactggcaataccggcatatcgggaaaggtctgattatcatgaacaacaaacgacgttcccagcgaatggaaaatgccgctctgcttctcggcgtgatcggggcagctactttttgtctggtctatccggcactgatctgcggatctcttgccatcgtttttgcacttttatcccggggcggcgagcgcacgctgacctcccgcgcgaaaattgctctgatccttggcgccattgccctgggcattgtcctcgccatgattatttacacatttgcgattgccgaattatattatggcggcgtggaaaatatggcgcgtcaggtatacggcacgctcggcatcgattttgatacactgatgaattccctaggccagtaaatccacatgccacacaaacagggcaagatttttgaccaggcagttgaccacgatcaaaagcagggcgatccatatatagacatcacgaaagcgcagggcaatccgtatccggcttccgctcacgcgttcaatggtctggctgatcataaaccagccgctaagcagcgccgcatacggcacaaacgggtgcagcacaaaggagcgcagccatttgccggcaagcagcgccctgacggctcttgtcccgccgcacccggggcagtacgctccggtcagcgcatgaaacgggcagggcagcaaaaatttccagaccggaattcctgttactctgacaaacaaaaacagcgccgcgaaaattcccgccgcgcaccagcccataatataaaaatcccggtctacccgtctatccgtctgaaacattccgatctccattcctatcttactccctgctattataaccgccgcattttcggttgtaaagcacgcgcacgtttctggattccaaatctctttaactgccagtagcatatcacggtcttccatgctataatgaactctggcgagttcatattagaagttcctgcggaacttcggatgcgcaaaaatctgcgcagatacagggaaataatgttcgcgaaagcaatgagcagtgccatccatgaatgttacaaaatccggctgcttgcagacaatattttgtaacattcatggatgatagggcgaatgcccgtgagtttgaaaatgccttgcattttcaaacccacaggcactgcgtaactataggaatataatgttcgcgaaagcaaaactttcaccagaacatacacaaatatcacatccacaggagtctacacatgtcaagatcatccagcgaattaaaacgtatttcacgcgacattttaaataaccgttattccgtaccgatggcagcatttctgactgcctccttaattccgacgctcatcgagattccgttctccatgacgctcggcgattatcccggcactccgcagcttatcatcagcacgattgcagatattttaattcttctgatcgcccagatgctagagaccggcgttatgctggttcatatgaatatgacgcgcggtcagacataccgcatccgtgatgtttttacaccgtttcgcaatggcgcagagcgcttctttctcgctgccgttctcttcgatgtatttctggtgatcgcaggtattcctgccattgccggtgttctttatttttataaaaccggtgtctccggtctctccggtgccctgcttgctgccggaagcatcctcggtctgatttttactttctgtgtgttgcttacctaccgcatggttttcttctttcttttagaccatccgcatttaagcgtgcgggatgcttttcgcacctgccgtaaatttatgcgcggacgacgcaggaagctgctttacattttattcagctttctcggctggggcgcgcttgccatctgctcttttggcattgcggctctctggatcagtccttatatgacgcagacgctgctcactttctatctcgacggtaccggcgaactggaccagattcccgtccgtgattacgatcaggaggcaagacgtttcaccggatctattttttgatatcttatggcaaatcagaagttctgatttgccatttgtatatacgcaactaccaatcattttacatcaggaggagtttactatgaacgaaaaagacggagcaatccgcgacgccagcgtacttggcgtaccaaaaatgctgattcttggcctgcagcatatgtttgccatgttcggcgcaaccattcttgtaccaattcttgtcaacagctacttcggcgaagatgttctacatgtacaggttacattgatctgtgccggtatcggaactttatttttccatctatgttccaaattcaaggttccggcgtttctcggttcttcctttgccttcctcggcggttttgccacgattgcaaacatggattccggtgtattcgccgacatgtccaacgctgacaaactttcctatgcctgcggtggaattgttgtcgcgggtcttttatatctgattctcgcgctgattatcaagcttgtcggtgtcaagaaggtcatgcgttttcttccgccggtcgtaaccggtccgatcatcatctgcatcggactgagccttgccggttctgccatcaacaacgcttccaccaactggcttctcgccctcatcgctctggttacgatcattattttcaatatctggggcaggggaatgtttaagatcatcccgattctgatgggcatcattatttcttatattgccgcattgatcttcaacgccatgggcatgacaaacgcagacggctccgccattctttcttttaccgacatcgcaaacgcttcctgggtcggcgtaccggcattttccctctgcaaattcaatctgtccgccattttggtcatggctccgatcgcactcgcaaccatgatggaacacattggcgatatttctgccatctccgcgacggttgatcagaattttatcgaagatccaggacttcaccgcaccctgatcggtgacggactcgccacttccctgtccgctctcgtcggaggtcccgcaaacaccacctacggcgaaaataccggcgtgctcgagctgagcaaggtatacgatccaaaggtcatccgcatcgcagcctgctacgccatcatcttaagctttattccgaagatggctgctgtgatcggttccatgccgtccgctatcatcggcggtgtcagcttcatgctctacggtatgatctccgccatcggcgtccgcaatgttgtggaaaatcatgtggattttacgcagtcacgcaatctgatcatcgcaggcgtgatcttcgtgtgcggtcttggtttctccgacggtcttacctttacgatcgccggaacctccgtcacactcaccgcgctggcagtcgcagcgatcgcaggtattttcttaaatgccatcctgccgggcaacgactatcacttcggaaaagacatcacaggtgacgcgaaccgcggtattgacatgaagccgaatcttcacgaagataccagctacacggatacagaggaataaaaatgccgcagaaagtggatgcggcagggatcgaagccggatcataaaaacgttttctaacgtttcaggatgcaaccggcggcggtcattctgatcgcataatccggtatttctaatccgcaccgcgtttgacatccacgatgatccgtgtctttccaagttttgagcactccgcgaaatgtgtccgcactccgcagacaatttaaggactttcgtgtgtgccccttgtcgacaccgctgaacaaaacataaccgcgcgaagccgatgtctgagttggcatctgccctattttcaatagcagatgccagcgagtttcggttcgcgcggttttatattgtctgtgaagcggtgccgctaggggcaccaggaagtccgctcattgtctgcggcgtgacgaacacatcccgcggattgtcaaaacgtggccaagacacagaatccgatgtcaaacgcgctgcggaagaaatacaaggattttgctccaaagaatggaccgtctccggttgcactctgaaacgttgtaaacctttttacatgatgcccgcgatccccaccgcttccgctttccgcggtatttatcagatgtagtgcagatgaatctctccgaagttcgcggagccattcagatacagcaccgtgctgctcgttccgatgctgctgccggtttcacggatggcgccgaacgaacggtccagattattctgaatcttccattctttcgggatgtaaaggttagtctccccgaaattattctccacgctcacatttgcagagccttcctgcacgatcgcattgtcgaagtacaccgaaagcgatccgaaattattttcgatggcggcgcgtctgaagttgtcggagttgatgtagcggattgcggaaccgaagctgttctcgcaccggatctcttcgccggtatactgttcactgctggatgttcccacattgccggtcaccgtcttccatttccgctttttcccgccaaagatcaatgacagaccgatgctcccaaggaatgccgcgccgagcaccgtccacggcgtgagtgctgtaattccaagcggcttatcatagatgatacagataaacgcaatcgagaacagaatctcccagaaattcacattgcggattccctcgacaaaaagccagaggaaaaatacggtcagaataatgctgaacacgccgatatccggcagaattccaaacttgcttataacgacatacactgctgcgaggataaaaaagattccccagaatactttgctacttttcatgatgcaacctcttttcttctaatttttgagtcaacggtttatagtaataccgcgatacatagaccttcttgtgcgtgtttaaaaacgccaccacacttgacgccgtcagattgcggtcaatagagtaaatctgatccgtgtttaagatcgtggatttggatactctcataaaaacgcccggaagcatatcttccagctcgtatagtttgtaccgggtctgatacatctcatcccgggtgtgtgcgctgatcccgttctcgtctgtctcgaaaaacaggatcttggacaatgtcacatagtattccgtgttccctttataaagcaggatcttctcggaagcgttggtgacatcccgcacggcgcgctgcacggcagcgacctgtttcgtcagaccgcggcagcggataatcacttcatcctccgcggcgctctcgtcaatctcaatttttattttcatctctgtaactcctttgatggttccagtataaaaaaagaacctcccggtgtaaacagttttacaccaagaggttattttctccgggtaagtggtaacactttcccgttcctgtcacattaaagtgtctttaacttctctacgcccgcatccagataagcgttctccatcgttgcaaacgctcccttgtctgcctgctccgcaaacgccggatcaagcggaagctttccgaataccgggatcccgagctcttttgcgacatcgtcgatatgactctcgccaaacagcttaatctcttttccgcagtccggacacttcaggtagctgaaattctccaccagaccgagcaccggcacatgcatcatctccgccatgttgtacgcctttttcacaatcatctgcacgagttcctgcggggacgtcacaatcacgattccgtctaccggaagcgactggaacaccgtaagcggtacatcgccggttccaggcggcatatccacgaacagatagtccacgtctccccagactgtctcgttccagaactgttttaccacgccggcaatcaccggacctctccagatgacaggtgcctcctcgtcatccaacagcaggttgatcgacatgatcttgatgccgttctccgtctccatcggaaccattccgtcgtccgttccgtatacctgtccatgaattccgaacatcttaggaatcgacggaccggtaatatccgcgtccatgatgcctaccttgtatccggcgcggttcatcgctgcagcgagtgatgctgtgacaaatgatttgccgacgccgccttttccgctgacaacaccgatcactttcttaacgttggatgccgcattcatcggctccttggcaattccgccgcctgctttattcttcgcgttgctcggacatccctcgcagctctcctttgagcagctggacgctccgctgcaattactgttctctggcatattctttcctccttaaatcgcttacatcttctctatcaggcttcttttttctctctggcacgcttttccttttctgcaaaaatcgccaccagcgactccgtgtaaggcgctctcgccacaccgtattcggtaacgatgcctgcaatcagctcatgatccgtcacatcaaatgccgggttgaagaccttgacgccctccggtgccatgcgctccttgtaccacatttccgtgacttcctccgccggacgctgctcgatcgtaatcccggctccggtcggcgtatttaagtcgatcgttgacgtcggcgcgcagatatacaccggcacaccgtaatattttgccacagccgccactacggacgtaccgatcttattcgccgcatctccgttcgcagccacacggtcacacccgacaaataccgcattgacccagccgttcttcatgactgtcgccgacatattgtcacagatcagtgtgacatccacaccggaagactgaagttcaaatgctgtcagtctggcgccctgcaatagaggtctggtctcatctgcaaatacatgaaaatgatagcctcgttcctctcccagatagatcggcgccgtcgcggtgccatatttactcgtggcgagctgtcctgcattgcagtgcgtcagaatgccatcccccggctttaccagagtcagaccatgctctccgatcatccggcacacccagatatcttcctcctggatcgccacagactcccggtgcagtgcctccttgatctgcgctacagtctccccactgtgtgcctccacaacacgctgcatccggtttaacgcccagcttaagttcacggctgtcgggcgcgaagaatccagatactccttctgccgtacaaactcacggtaaaatatatcgtaatcctccgtatccatccgttttgccagcacatagatcccatatgccgccgccactccgatcgccggtgctccgcgcacctgaagcagatagatcgcgttccagatttcctgcgccgtgtgaagcgaaatgatctctatttttcccggcagcttcgtctggtcgatgatcaccactgcattgttctcatcatccagccgcacggtgtcataatccataatattcctgctctgctgttctcccacactttcacccctttattcttattcatcacagactattatactctcttttgtcgatgtttccaagaatacgcccgccttctcgtgttcttttttgcggacaaaaaaggaattgccgcaataagcatagatcgtttgggtgataagtaataatatgagaagaccacaccgtgggatttcagatggaaatacaaatggaaattcgttggagaaaaatgtgtgcatttctttctgctgaatgtttgcatcggattccgtgtctcttccacgtttggaaaatccgacgggtgcatgtccgacacaccggagacaatgggcggactttctggtgtccctaatggcacctcttcacagacagtataaaaccgcgcgaaccgaaactcgccggcatctgctattgaaaataaggcagatgccgactcagacatcggcttcgcgcggttatgttttgctcagaggtgtcataagggacacacacaaaagtcctacaaattgtcttccgggatgcggacatgacccgcggagtactccaaacttggaaagacacggatcatcaaagatgcaaacattcggctggttagaaatccacattttttgaaccgaatttccagctgcatttccacatgaaatccccaagtgtatttcttctcgtaatattacttattgttcctagtagcggagtgcttttttcagtgccatggaaaccgctgttccgataacgaaacatacgatcgcctcgacaacgccgttcacgccgacaaatgctgcgataaacgggatcactttcgtcatgccgaactgctcacgcattgttcctgcgaacagagttaccagtgttcccatgaaaaatgtggtgttcagcagcggacagcaaaggctggcaagcgttaccgaacctgcggaaggtattttcgtcttcttcagtcccttgtagatcagtccggtcagccatccgtccagaatacgtgtcggcacacataccagaaatgtgaataccgggtttacgcccagaaggagcgtaccaaacgcgctcattccaaaacactggataaaactcgtgataccgaacacaccgcctaagattgctcctgccgccggtcccaatgttacagctcctaccgcaactggtatgacaatcagggtaatctcaagacctgctgtctttatgtaaccaatcggggtaaaagccatgagtaagatgatggcaaccaaaagcgccatctccacgagatacttcgtagaaaatttcgacttcgtcatagtcttttcctcttttctgtatactttgtttatggttcctgtctgccaggaactttttgcatcttttgcagtatatcactatgtgaaatatttatcaagcggttggcgccacaagaccacattttttccgccaggttcccgccagatatcttcccacaaaacagagtacacggaacacccagtcaattaccatggcagcccacaccccgactgccatccatcccatgtgaacaccaaacacataactgaagccgatacggaaggtaatcatggaaaaaatcgacacgaccatcgtgtattttacatcgttgcaggcgcggagcatattcggcagcacaaacgacgccggccacaggaagatcgccattccatcatgaatcatgaccagaatgtaggacaggcgcgtcgtctcctctcccagtccatagatctgtaaaatccacggcagcagaagtaaaatgatgctgttgatgaccgccgtataaaaataggtctctcccagcagctttttggtgtaatagcgcacctgtccttcttctccggctcccacacagcgtccgatcacagtaatcatcgcaaggctcatcgcctgtcccacaatacatcccatggaatccagactgttcgccaccccgttcgccgcgatctggctggtgccgaacgcagctatgatgctgaccacaagcacacgtcccagctggaagataccgttttcaattccgctcgggatgccgataaaaagaatccgcttcacaatcgttgcgtccactttaaattttcctctggtgagaaagaccagattgtccggattatgcaaaagcgtaaaaagcaccactcctgccacaccgcgggaaaccaacgacggaatggcgactcccgctactcccagtttcagcacatacacgccgattgcatttcccacaacgttgatgacattcatcagcagcgatattttcaatgtgatctgcgcattccccatcgaacggtacagcgccgcacacgagtcatacactgcgagaagcggaaatgagaacacggagataatgagatagatgatcgcattctgcataacatccgcctcaatctgtccgaagaataatccgaggatctgcctgtgaaaaagaagtaccagtacactgataccgatcgtgatcgccgcctctgtaaacacaagctgtctggcagaccgacaggcttcctctctccttcccgcaccgatacactgtgacgttaccaccgcaccgccggtcgcaagcgccgccagcacactgatgattaagttgttaaacatgtctaccagcgacacgccggaaactgccgcttctcccgcagaagaaatcatcatcgtatctgccattcccacggtgatggcaagcgtctgttctaagatcagcggaataatcagtttccgcaaatcttttttactgaataatcgattttctgttactgtctgtctcacgttctttcactccttcggaatgacaataatacgcaaaacggcaactgtcaagctcgtgaaataaaaacataaaaactcccgcatgacagacgccacatctgccacgcgggagttcttttcacctatgtacttttctttgcttatttgccaagttctgcctttaacgcagtggtcagtgccggaacgatcttgttgagatctcctaccagaccataatctgcaacgtcgaagatcggcgcatcctcatccttgttgatagcaacgatgagatcagaatcctccatacctgcaacgtgctggatagctcctgaaataccgattgcgaagtagatctgcggacgtactgtcttacctgtctgtcctacctgtaaatctaccggcagccagccgttctccactacggcacgggagcagcttacggtaccgccaagtacctctgccagatcctcgagaagcttgaagttctccttggaaccaacaccacgtccaccggataccaggatctttgcatccatgatgttcgctgtattcttaacagcctttacaatgtttaagatctctacatatctgtcattcggggtgaatcccggattgtactctaccacatttgccttagcgcctgcgatcggagcgatcttctgcataacacccggacgtacagtagccatctgcggacggttgtacgggcacgcgatcgttgcgatcgtgttaccaccaaatgcaggacgtgtcataagaagctgattgtgctgctgctcctgtccagctgctgcgttcagcgggaaatcgccgatctcaagcatcgtacagtcagcagtaagacctgtcttcacacgagcggaaacagtaggtccgaggtcacggccgattgcagttgcgccaaccagcatgatctccggcttgtactcattgatcacagatgccagtgcatgtgcgtacggctctgttctgtagtcttttaactgcggatcgtctaccacgatgactctgtcagcgccgtactcagcaagctgatctgccagctccttaacgccggagccaatcaatactgcagttacttctgtgtttaaatcctttgccagctcttttccttttccaagtaactcgaaagcaacgccgtctaatacgttgtcaacctgctgtgcaaagacaaatactcctttatattcttctaaacccattttattcaccacttttccttatatttgttagataatgtgcttctctttgaacttgccgatcaggtatgctacggactcatccggatcaaggacaaccttctcgcctgcgcccttacgtaccttgtcagatgcctttgcgatctttgtcggtgatccctttaatccaagatcagaatcatctacatccttaagatctgctcttccccatacggtaacttccttatcgtatgcgtcgaagattccgcccggagtcatgtaacgcggctgattcagttcggaaagtgctgtgatcaggcacggcatctttgcctttaactcatggtatctgtcctcgtactgacgctgaacaacgacatattctccatcgatcttgatgtcctgtgcgtaggaaataaccggaagtcccagatgctctgcgatctgcggtcctacctgagcggtatcaccatcgatcgcctgacgtccggtgatgatcagatcgtaatccagattgcggagtgcgcctgcgattgtggtggaggtagcccatgtatcagctccgcctaacacacgatctgttacaaggattcctttgtctgcgcccattgccattgcctcacgaagcacctcgtctgccttcggaagacccatggtaagaacggttacttctgcgccgtactgctcttttaatctaagtgctgcctcaagacctgctttgtcatccgggttcatgatggtaagcattgcagctctgtctaatgtaccgtccgggttgaacttaacgccgcccttggtatctggtacctgtttaatacatactacgatattcatgtatttttcactccttatatttttatattatgccacggattacgactatttcagtaatgcaccagagataaccattctctgaacctcactggttccctcgtagatctctgtgatctttgcgtcacgcatcatacgctctacatcgtactctctgatgtaaccgtatccaccaaacagctggacaacctctgtggtaacagccatagcagtctctgctgcgaacagttttgcctttgcagcctctacagaatataccttctgtgttgcctttgccatagcagctttgtatacaagaagctgtgcagcctcaattcttgcagccatgtcagccagcttgaactgtgtattctgctgctgggcaatcgtacggccgaactgttttctctccttggtgtatgcgattgcgcggtctaatgcgccctctgcgataccaagtgcctgagcagcaataccgatacgtccgccatccagtgtgtgcatagcgatcgggaatcccttgccctctacgccaagcaggttctccttcgggattctgcaatcctcgaagatcagctcgtatgtagatgatccgcggatacccatcttcttctccttggttccgaaggagaagcccggagctcccttatctacgataaatgcagagaagttcttcttctttctgcctctcttatcctctgttacgcttgtgattgcgattacgatataaacatctgcaaccttaccatttgtgatgaagcacttggagccgtttaatacccactcgtctccgtctaatacagccttggtctgtgcgccctgcgcatcggttcctgcacccggctcagtcagtgcgaatgcaccgagcttctcgcctgttgcaagcggcttaacgtatttctgcttctgatcctctgtaccgtaggtcataatcggatcaatgcagagagaagtatgtgcagaaacaataacacctgttgtagcgcataccttggacagctcctctacgcacattacataggtgagcgggtcacagccctgtccgccgtactccttcggtaccgggatgcccatgaagccgagcttctgcatcttcttcacgttctcaaccgggaattcctctgtctcatctacttcctgagcgagaggctttacctcgttctcagcgaactctctgaacagggagcgcgccatttcatgtttcttgtctaaagtgaaatccatgatatcatttcctccattattaccttatattttactgagcatcaaccggggtctttgtacggtcagcattgtatacatagaatcccttgccgctctttgcgccaagattgccgccgcgaaccatcttgcggattaacgggcatgcgcggtacttgctgtcgcctgtctctttgtagagaacatccatgattgcaaggcagatatccagaccaataaaatcacctaactcaagcggtcccatcggatgatttgcgccgagtttcattgctgcatcgatacctgcgatatcagatacaccttccatcttaatgaaagctgcctcattgatcatcgggattaaaatacggtttacaacgaagcctgctgcctcatttacctgtaccggagtcttgccgatctctacggaaatcttcttgatcgcctcaacggtctcttccggtgtattcacacctgcgataacctcgattaacttcatacggtctgccgggttgaagaaatgcatacctaccattggacgggtcagtccgttgccgatctctgtgatggaaaggctggatgtgttggatgcaaaaatgcactctggctttgcaatcttatccagctcctggaatgtagtcttcttaacgcccatatcctcgaaagccgcctctacgatgaggtcacaatccttgcaaaggtcttcctttaaacctggggtaatctttgcgagaatgccgtctactgcttcctgtgtcatttttcctttctcgacaagtcttgcatagcctttcttgatcttctcttttccgccgtcagcccactcctgcttgatgtcgcagagtgctacttcatatccgtctacctgggcaaatgcttttgcaataccctgtcccattgttcctgcaccaataactccaactttcatgtctgtacctcctgaaatatcatatatatattctaataactgattctatgccttttaataaaataggaacaaagattcctattacgcaaagcaagaacttctccggtgccgcccacaggctggcgccggttcagaagttctcataactgcattagtctctctcaacgatggtagagcatcccataccaccaccgatgcacagagtagcaagacctctctttgcgtctctcttctgcatctcatgtaataaggtaacaaggatacggcatccggaagctcctaccgggtgaccaagtgcgattgcaccgccgtttacgtttaccttggacatatcaaacttcagatctcttgcaactgcaacagactgtgctgcgaatgcctcgtttgcctcgatcagatccatatcatcgatggtaagtcctgttctctcaagtacctttctggtagatgcaacaggtccgacacccatgatctcaggctctactccgccgagtgctccggctacccatgttgccatcggcttaacgccaagctcttttgccttctcctcgctcataacaacgattgcagctgcaccatcgttaataccggaagcgttacctgcggttaccagtccgccctctttgccggagcaacattttaacttggacagtgactcagctgttgtgccaggacgcggtccctcatcttttgcgaacataacggtctctttcttaaccttaaccggaaccggaacgatctcgtcatcgaacttgccctcagcgattgccttctcgcacttctgctggctgtttgcggagaactcatcgagttcttctcttgtaagaccatacttctcacatacgttctcagctgtgatcatcatgtgatagtggttgaatgcatcggtgagtgcatcgtttaccatggtatcaatgatggtcgcattgttcatacgatatccaaaacgagccttcgtcatggcataaggagccatggacatgttctccataccacctgcaacaacgatatctgcctgaccagccagaatcatagtagctgcttcattgacacatttcagtccggaaccacatacaacgttcagagtaactgccggtacttcgatcggaagtcctgccttgatggaagcctgacgtgcaacgttctgtccctgtgctgcctggataacacatcccatcaatacttcatctacctgctccggctttacgccagctctgttcaatgcctctttgattacgattgatcccagctccgctgccggagtattgctcagtgctccacccatcttgccgatagcggtacggcatgcgcctgctaaaactactttctttgccattttgaattctcctttcagttttacacacaaaaccccgtatgtacggggaatttgttcctctttaaaaaataattttgccgaaaaacgctgttaattttttaacaatctttttgctaaaaaaaataaattcaactttgcagttaaaatttatgtttctccctctttttttcacaaggtgcattttaaataatcggcgtttttactagctttttaatactttttcatgctaccatatttcactcttaaatgcaataactttcttcttttttcatctttctaatgttttctttacgctcctttttccccctctatacgtctgttttacagtctttttttgttaaaaatttatcatgcaaattttattttccaaacaaaagcaaagcgattcttgtgtacttttcacaaaaatcgccctgctgccattctgcggttttccgcacttttttcacttctaatagaatacatggtttccaattacggttccctgtatgatgccgttattctgtctgaaatacaggcagcccaccgtaatattgccgtttagcacatcctgtgccgcctgaaggcagcttccgtccacacccgcttccagacgatacgccagtctgccgctcgccaccggcgagaactgaccgctctggtaaatcacacccgagacagagttcggaaaatacgaactcttcacacggtttatcacaacgcttccgaccgcaagcttcccgtcgtaggattctccgcccgcctcgcactggatgattgctccaagcaggtactggtcactgtccgtcggcacatagaccacggtggaggtatcctccttctcctgctccttaatcgccgccagacgcgcagcgtcctccttcgccttctggatctccagctgcttctcgtactcgaccatctggttgatcttatcctccaggtccgcgacgttggactgcgcatccgccagatcttcctgtgtctgcgccagattcgccttggtggtgttgatgagactgctgacgttcgcctgctttttcttcatgtcatcctgcatcgccaccagctcggtcatatcactctccagatcttccttctgggcggctatctgctcctgcagatcctggtattccacaagcttttttctgtcgtaggcgttgatgtcggtaatatattccgtgcggttcaggaagtcggaaaaagattccgcctccgcaagcatctgccataccggcgtgcttccgttctcatacatgaactgaatccgcagcttcatatcctcatactgtttcgcagactgtgcctccgccgcagccagatcctccttcgcctggtcaatctccccctgtttgtccgaaatctgcccctccagatcattgatctgtgcgacaatatcggaaagctgaccgtttaacccgctaagatccgactccagtgcatcctttttgccggagatgtcattgacggtatcctcggcatcctttttctgatctttcagatcctcaatctgattcttcgcatcatttatgttgtcctgtgtcgtctcggcataagatgtatttgccagaagcaggcacattaccagcgctgctcccgccacgcgtctccacggaatctgtatcataagtacctctttctccggaaaagtaggattttctttcaaaaaccccggttctaagagtatcatatcagattgtatttcagctttcaatatgctatcatagagggaagataaagaggattttggtatgacaataccggaagagggggagataagcatgcaatttgtcaaaactgctgatctaaagcccggtatgcgccttgcaaagccaatctacaacaggatgggggttctgttatacgaacgggatacaaggctcacgatccagggtattaacagtattgagaattttggtctgatcggcatttttattctggagccggctgaaccgctgccgccgctttcgcgggaagatctggagtttgaacagttccagaccatctacatgttcaagttaaaggacaacatggacaagcttgtcgacaatcttgtcccgtccacactgctctcgctggtcgatgatatccagcggcattacggcagtcttgaccacaagctgaattttacgcagacactccgcagttccgcggactttgtatacaaacactcgatcagtgtcggtatcctatccgcaatgatctccaatgagatgcagctcccggcagaagatatccgggcgctgatcacggcttccctgctgtatgatttcggttatctgtatgttccgcaggccatcctcgacaagggcgacgacctctcggacagcgaccagaattttatccagatgaatctggaacgcggttatgaatcaatccgcccgcgctatgaggagtgcaatcttccgaagatttccttagagattatccagcagttcatcttccagaagagtcagaccttaaagatcaaggatccttccccggagacacgtctgctctgtgatattttaaaggtggcagatcagtttgaccggcttaccgccatgaatattaacaatccgccggtctcggaggttgccgcgatgtcttttttgcgcagacacagccggacctacaatccgcgcgtcgttgccgcactggcggaatgcatccacattctcccgaccggcgcgtgcgttgatctctccgacggtgagaaggcgctcgtcctcgtggaaaatgccgcggattttacccgcccgatgatcttaaagttctccaacaatatgatctacgatctgagtgatccggtcatcggagattccctgcgtgtgacggacatcatgaaaaccatggacaaccggattgcgatcgacgaggaggcgctcgagcattttgtcgcagaccagtacatccgtgagacggctgaccgtttccggcagaaaaagcttgccatcgcacagcgcaagcagaaagctgcccagaagaagagcatggatgatcttttggacaatgccagagtgcttacacctccgcccatcgcaccagtgccggaagaggacgcttccccgatcaggaaagctccccgcaagcgcatgaaactggtttaatattttatgtgaagggtgggaacggcgtatcgttccggatgcagcccggtgtgaagcattctaaccgccaaatccggcatttctagccgcatcgtgtttgacattctcgatgatccgtgtctttccaagttttgagcactccacgaggtgtgtccgcaggttgcagacaattttaggactttcgtgtgtgtcccttactgtcatcgctgaacaaaacataaccgcgcgaagccgatgtctgagcaggtatctgccgtgtcttcaatagcagatgcctgcgagtttcggttcgcgcggttttatattgtctgtgaagcgatgacattagggacaccaggaagtccgcccattgtctgcaacctgtcggacacatcctgtggattgtcaaaacgtggcaaagacacagaataaaatgtcaaacacgacgtggaagaaatgctcgtattttgcttcaaggatgcttcacaccgggctgcatccggaacttatatcctcccccctgcatatacagcgcggttattttgcttccacataaggattgttttccgccatccggcgcgcctggcgcggagtacagtggtaacgctccttgaacatccggtaaaaaagcttctgattaaagaagccatgccgctccatgatctcctgtaccggatcgtccgtgtgcagcagatcctgatagatataattgagccgcacctgatttacatagcgcataaacgagctgccggtgctctgcttaaagaaccggcagaagtattcccggttgagccccagttcatccgccgcttcctgcagcgtcatttcttccctgtagtgatgatccacatacatacagatctgctccagccgctccatcttccccgccctcgtctgcgttgccaccatggagacaggttccgaaaaatgttccaccagacatgccagcaattccagaatccgcgccgtgctttttaaccggtacgtctcattctgattcacataaagcaccgtcagttcttttaaatacccgcagatttcattgtaatattcctgctgccctggacggagacgctgtcccgcgcagcggatcgcaaaaggttccgcctccggcagatagcgccgcagaagctgccttgacacgtggatacagattcccattgtctgcggcagcgcatagatgacttcatgaattctggcatagtccatcacaaccgcgtccaacggattcagttcgtattcctcaccctccatatgcacagtggcatgcccgtttaatatgtagagaatctccatctcccggtgccagtgaaacggagagttatgatccatcgtaacaaaccggatatcaaagccgacgtccggttcgagcgtaacattttcatatgtatttttctgttcttccattttttctcctaaaagtcaatatcacccaactttttgctaatatcttatctataatattaccatatttccgtgtattataatagctgtcaaagggaaaacctttgatgaacaagcaaaaatgtaccaattcaataaaggaggaaattattatgttagcaaaaatcaaagcattcttcatggagaatatcgacggagtcgcaatgggtgttgaagcaatgtacggagttgacattcatccatattacaactaatcccggagcaacgccatgacaacagaaaattttaccaaaaaagagcctgtaacggtgcgatgagttctcatccatccgtatacaggctctttcttatttcataagaaataccttgacacattaatgtacgaaagtaggtccttcctatgaaataagaatcgctccgcgcggatgcgcagctcgcggtatggaaaatatcgctttgcgaaccgctcgcgcgcggagaatctcgcaagcgagattcttttttttgtttataaattcttcactttcgcaatatcaaccggagtcagcgtatccatcgctgtctcaaggcttcttgcaagtgcgtttgccgtatccatcgctgtgatacagtacacgccggtctcgatcgcatttcggcggatcaaaaagccgtcgcgcgtcttgtctccattgccctgtgtcggagtatcgatcacaagatcaatcttatgaccaaggatcagatccatgacattcggggattcctgtgtaatcttattgacacgcagcgcattcaccccatgctcctgcaaatatttcgcggtgcttctggtcgcgtaaatcttgtagccgagcgcttcaaaacgctttgcaacgccaacggcctccggcttgtccgcatcctttaccgtcataatcatctgcttatattttggcagtgtcacaccggcaccaaggaaagccttatataatgcctcgttgaatgtctttgcaataccaaggcactcacctgtggacttcatctccggtccaagggaaatctccgctccgcgcagcttctcaaacgagaataccggcatcttgatggcaatgtaatcagccgtcggtgcaagtcccggctcatagccaagtccgcggattgtgtttccgataatgaccttcgttgcgagatcgacaatcggaataccggtcaccttgctgatgtacggcacggttcttgaagatctcgggtttacctcgataacatagacctcttcattcatcgcgataaactggatgttgatcagtccgatgacatgcagtgcctgtgccaggcgcttcgtatattccacgatcgtctcttttacatgatcgctgatcgtcggtgccggatagacggaaatactgtctcccgaatggacaccggttctctcgatatgctccatgatacccggaatcaggatgtccgttccatcacacacagcgtcgacctcgatctccttgccctgcagatatttatcaacaaggatcgggtgatcctgtgcaatccggttgatgatgccgatgaattcctcgatctcgtcatcgttaaatgcaatcttcatgccctgtccgccgagtacataggacgggcgcacaagcaccggatagcccagacggttcgccacttccttcgcttcctccgcggtaaataccgttccgcctgctgctctcggaattttggtcttctcgagaatctcatcgaaaagctcacgatcctccgcagcgtcgacgtcctccgccttggttccgaggatcttcacacccatcttcatcaggctctccgtcagcttgatcgcagtctgtccaccaaactgcaccaccgcaccgtccggcttctcaagttttacgatggcttccacatcctccggcgtcaatggctcaaagtacagcttatccgcaatatcaaagtctgttgatacggtctccgggttgttgttgacgatgacggtctcccagccttcttttgcgaatgcccaggtacaatgtacagagcagtaatcaaactcaattccctgtccgatacggatcggtccggaaccaagtaccagcaccttcttgttcgggtgcgtctcttccgcctcattctcgctgccgaatacggaatagtagtacggtgtggtcgcctcgaactccgccgcacaggtatctaccatcttgtatgctgccacaataccgtttgcgtagcgcatatcatggatctctgtctcggtctttccggtcagttctgcgatcaccttatccgggaactcgattcgttttgcctcttttaacagttctaccgtaagcggctcgctctttaacttctgctccatctcaaccaggattgccagcttatcgatgaaccacttatcaatcttggtgatgtcgtgaatcacatcgtaatccataccgcggcgcagtgcctctgcgatcacccagattctccggtcatccacaacgtgaagctgttttaccagttcctctctggaaagtccggtaaaatcataggacatcaggctgtccacatgctgctctaaggaacggatcgccttcatcaaggctccctcgaagttattgcagatactcataacctctccggttgccttcatctgtgtggtcagtgtacgttttgcggtaatgaatttatcgaacggcagtctcggaatcttgacaacgcagtagtcaagcatcggctcaaagcttgcgtaggtttttccggtgatggcgttcttgatctcgtcaagcgtatagccaagcgcgatctttgcagcaacttttgcaatcggataaccggtcgccttggatgcaagcgcggaggaacgggacacacgcgggtttacctcgatgacgcaatactcaaagctctccggattgagtgcatactgcacgttacatccgcccgtgatatttaattcagatataatatttaaagcagaggtacggagcatctgatattccttgtcgcccagcgtctgtgacggtgcgactacgatggaatcgccggtatgcacgccgaccggatcaatgttctccatgttacataccgtgatgcagttgccattcgcatcacgcattacctcatactcgatctctttccagcctgcgatgcagcgctccacgagcacctctccgacacggcttaaacggagtccgtttgtcaggatctcgatcagctcggtctcatcgtgtgcaataccgccgccgcttccgccaagcgtgtacgccgggcggagcacaaccggatagccgatggtgtttgtgaacttaataccatcctgcacattgtgcacgacctcggatgccgcacaaggctctccgatcttctccatcgtgtctttgaatgcctggcggtcttccgctttgaaaatggtctctgcggtcgtaccgatcagcttcacgccgtacttatccagaattcctttctcggaaagctccatgccgagatttaatccggcctgtccgccaagggtcggaaggatggaatccggcttttcctttgcaatgatctgctctaacaccggcacggtgagcggctcgatgtagacctgatctgcaatgtctttatccgtcatgatagtcgccgggttggaattgaccagaacaacttccacgccctcttccttcagggaacggcatgcctgtgttcctgcatagtcgaactccgccgcctgtccgatgacaatcggaccggaaccgattacaagtaccttcttaatctcctgatttcttggcattatttcgctcctcccatcatgtttataaatctgtcaaacagatatgcagaatcctgcggtcccggacacgcttccggatggaactgcaccgtgaaaatgttcttgccgacataggaaagtccctcgttcgttccgtcgttgacattgacaaatgctggtgtcgccaccttcggatccagagtatcggtgtctaccacatagccgtgattctgtgaagaaatgtagacgcggttcgtcgccagatccttgaccggatgattgcctccgcggtgtccgtacttcatcttgtgcgtgtcagcccccgttgcaagcgccatgagctgatgtcccaggcagattgcaaaaatcggcgtatcggattcatacagcttgcggatctctgcaatgatctccttgcactctttcgggtctcccggtccgttgcttaacataatgccgtccgggttcgccgccagaatctcctccgcagaagtatgtgccgggtataccgtcacctcacagcctctctctcgtaaggactggacaatattgcgctttgctccaaggtcaagaagcgccacttttttcgtctcaggggcatttccctgcttttttaatactcgtttttccgtacaggtaactttatctaccacgttgcctgtcgtgtatgcttttaatttaggaatgatttcttctatattatagttctcattcgtcgtgatcataccgttcatcgttcccttctcacgaaggatcttggtaagcgcacgcgtatcaattccggcaattcccggaatatcgtattttgcgagaaaatcctgaatcgtcccctcgcaccggaaattgctcggcattctggacagttccctcacgatataaccgtccggccacggccgtcccgactccatatccggcgtgattccgtaatttccaatcagcggataggtcatcacaactgcctgtcccgcataggacggatcggtcagaacctccagataaccggtcatcgatgtgttaaacacgatctcactgatgacctctctggtggaaccaatgctggttcctgtaaatacattcccatcttcgagtatcaaaaaagctttcattcgtctccctgtcctttcacttttttcccaaaaaaaaaaacgtttccgtttttcttcttttttccagaacgcacatgcacacggtgtgtgatgcatcgtcttcgtgccattatgggcagtgctatgcctttttcctaaattgtaaaaagtttatcatatcacaggatatttttcaacctttttccggaaccaaataatgtataatttttacactgtgatgtataaaaattatacattatggacaaattggacgttcatcgtcctatatcaacaatatgatcccaccgacacaatggcgtttcatgcgaaatcagcaatataatgtgttccttttttcgttgctctaactccttatagaagataattttactttcttcatcaaggtttgctgtcggttcatctaaaatccatatgcatgaatccgataacaatgttctgacaattgctatcttttgcttttctccccctgaatatatcttattctctctatgctttgtactatccatatctacaaacttcatcagcgaatccaatttcatttggctcactaatgctttcaattcatccatatctatccgattccccttcaaacatatattctcttgaattgttccatcaaatatatagggatcctgctctataacagccgtattgttgttaataaaccacttataatccaattcacccagtctgtagccattatatatcacttgccccgtatacgaggttccataaattccaagcattatattaacaagagatgattttcccaccccatttctacctctgatccaatatatctttcccatgcaaaattccgttgtaatgtcaaaaagtctattttgtccaggataagcaaattccaaattttttaattctattttctcaattatcctttgcctttcttttcctgtcggaatttcatctaatactaaatatttttttaatcgttcttcgcttgcctttaccgtctgataagaacttcctatattcaagaaaaattccatacaccccaatacatatacaaaataatttagcataacaaccaatgttcctacagacatactatccatttgaatcattctgccgcctgctaaaaataatgcggtctgaaatatcaatatcaatatatcttttagaacattatatatgctgtatgctccaatttgtttttttaaaacgcgcaacaaattctgatagtcattctccatacatccgaaatgatattgactcatcccattcatacgaatagataccgacttttcaattagctcgaacaatgttgtagcataatttgttttttgttcaataacctccttttctgtccggtatatcagcttttttgaaattaaataaacgcccgtgtatgcaatcatcatcaatataacaagactccctattaacaaggagttttttatcagcaccaaaagatacacaattgtagaaaccgtctgaacaattatatttttaaaaaaagatacataaaatgatgctattatcccagtatcattattaatcttctggcttattgctgccggattttccttgcaatagtttaaatacgaagtattatatactattttcagcactttccgtgtcatgccataacttaattttccctcaatagacacccgctgatattccattcgtatgtagcatatcctatttattatattcaatcccacatacaccacaatatattccacccattccctctcttggcatgaagctataatcagatccaggaaatgtcccacaagataagttaaacaaattcccactactccagagatagtgcttattatgatatatcccgtcaactgctttttttcaagttcaggatataccaattcatgaaaccccgtcatcatctagtcctctcttatacggatcagaatacagcctgccaacagcataagcaacgttaaggcagaaagctgtggcagccattccacgatgcctttaccggttccatctgaggctgtcgtttgaacaatccctgtcatacaaaaagctgcacatatcatcaatgcgttcattttcgtttttacaataaaagaaatgagcagaactgcagccgtcagaaaaactatatacagaagcattcctaatatttcttctcgcacaagactccatatcgatatcaccgtctgcgtcccttgttcagaaatcaccagaagcatctgtcctccggttccatatcgtgctgttccaagcagaaataatatgcctgccgcactgccaacacatacgacactcaccagtacacgtacaaaaaatcgttccagatacaaccattccttttttattggcaggatgtatagtctgtaacaagttgcatattcaaattcattcgcccacgcatcaaaatgcagcaaaataatcaaaactgtaaaaatcaaaaataatacactgtttccagaaaaagcctctttccataaccatgcagcctgaggcacaaccggacagaccggttcctctgttccgctctgctgatatgctttatgtaacagcatacgtgctctccaatcagcaacactccctctgaatatgcccgtatactccacttcctctcccagttcctcaatcgctattaaattttcgtcttcctccagcaccgtcctgcgaattccattctcatcccaagcctgttcccaataataacgcaaccgaatattggtctgttcgtactgtttccatgcatttagcaataaactggcatgtgcaaatttttctgcactattgtccccccatagttccatgcactgcctctgatactcagattcccagatcgtaatatcttttgcattttcttccagttcttccaacactgtctgcgcataattctcatactgtgtaacatagtaaaatctatatgcaaaaacaaccgccagcgcccctactatccagaccaagtaatttttccggctaaagaaaagctgtatttcattttgcaaaaatgctttcattcttatctgctccatacaaatttttgtaaaattcttcaagattttcaaacctgcctgaaagatcatcaagctttccatcaaaacaaacaatgccatcgtcaatagcaacgattcgatctgcaatcttttccatttccgaaagttgatgggaagagatcaaaacagcgctccccctctggcgaatctcctcgatttcccgtcgcagacgaaaaactgcttccgggtcaaggccattggtcggctcgtccagaattaccagtttgggttgatccacaatcgctattgccagattcagtcgcattttcattcccatggaataagttccggtgcgatccaaaagtctgtcccccagatctgtgaaaacggcaagttcctccacccgctctttgggtacctttctggctgttgctgccatccgcaaattctgtataccacttaattccggataaagagcggggacttccatggcaattccaatctgttttaatgcttctaagcggttgcttttgatgtcattcccacagattctgattctccctctatctgtcctgtataatccactgatgcattttattgtagtcgattttccgctcccatttggtcctaaaagtcctacaatctcccgttcgcccacggaaaaacttaatcccttcagaatcttttttcttttcttagacttttcaatatcctcaacctgtaaaaccttcattccgctctcccctatattctgtcttttttcccggatacagtacacgttattatcataatcaaaatacagctgaatgttagttccaataccgcatatagccatgtgatcctttctgatcccagcgtcacattccagcaggatccaatcgcaaacggattatatggttttccccagcctgtcaactgactgtatcctgtaagtacggttgctgctgccaccacgaaagttccgccctgtgaatgctgtatcagcactcgaatcccgcttccaagcattgcaaaaaacaaaacttttaatactgcaagtatacacatatatagcaagaaacgatataacggaagtgatcccaacggataagttgtatacaacatgactcctcttcctccgtctgtatacttataatccgcatacatgcgggctagcccctcataggagtaatcttccaaatgctcgtatgaataaaaccccttataggttttagcatccacaaacatatggctgtcaatcccattaaagccgtatcgcattccccaatacaaaaaccacacacctattccaatcacacacacaactcctgccgccaggaaaaaggatgtcacataatgcctgtatttcttccactcactgcatggctgcactgtcataaattcatacctgtggtcattttttccctccataatgtagccaaaggaaaataacaggatgcaaatatctaatattgtaggtacatacgcattttcacaaaatagaatctccaaaaaagcatagggcgatcccgaatccaatcccagactttttttatcataatcatttaataaatgttccagacggctcatattattctcatacgctgcaacagaagcttccatcagttcggatgatacatatggattcgcagtcatagaagaaatgtcaaacggaaggtcataaagtcccagctgcctgccccatttctgaaacatatctgcacaacgtacttcaacagggctgcatccacgctctggataaacaaacatctggtatgatacaatactgcatatcaccccatatgccttatattccttctggaactgctgtgactctgtcccacccacctcaagcaatgcaataagttcctgtaattcttctattctccatttacgaaattgtattgcatttgtattaaattttcgccgttctgcatctcctgcatctctgcgcgcagtagcaagctccgattctaacagctgccgatgcatcacaagttcatattgcagttcccgctttatatagttcgtgtcctgactggatgtaatcgatctttgcagttccaccgtagcttttaatccaaaaagcagaacaaccaacagaaaaatataggctgccttatttctaagaatcgatactatctcatatttcaacatacttttctccgtctttatcataaaggtaaggtgtgctgccacaccttacctttatgatacttgaagtttctcacatttttaatttcataaatggaaacttttccgacatttatgcaggtttttcaaaaccttgcattttccctatgtccgttttatactgtttgtagtttcatataaaggagctattttctatgagtgtacaacatgccggttctattattagacaggcccgccttaatgcgggtctaacccaggaacaattatccgatggagtctgttctaccctctctctgtcccgcattgagaacggctctgccggtgtcagccctgccacttttcagactttaatggcacatgctggtatcttttgtgaagcttatcctactttctcgacgcgcgcagactttgactgcttttacgccttgaaggaagtacgcttttatctggattcctggcaactcacgcccgcctgccagttattggatcacattgaaatgctgaattgggcagacaataaattttactatcaggaatggcttctgcttcactgcaagctgcaattacgttctggtcatgcaaatcacgcccatacttatgagctggttcgctttgctttaaaaatcacaagatctgatatcgacaatgcagcgatccattctctgtttttgtcttctgtcgaaatagaactatttatatatcttgcgcaggaagcactgtacattggtgatacagctactgctcatcatgtctgccagcagatttcttcctatctctctgcccgttcgctttcttttcttgaacgggatcgtttacttgcggaaaatgcggtggtatataccaaatatctgctgactgtctgtgattataagtctgcacttgaactgtcgaacttctaccgccatcaaatgatttcaaatcttgacgacgggcttatgcatgagctgacgtttttaaccgcactcggatgctactatacgggacaacaggatcgttttctgaccttatttaaaactgcctttttctctgcccattccattaacagctgttatgccaccatctgtaaaaattatgtttccaaccacctttctaccactttggctgaagacttaaacatattttccgatattccgcttatatcgttttcccccaaggttcctagggatgtctcttctatgggagatggcacctatgactttttttctcacaaggttttcacgctgggtggcctgatccgctctctacgcaaagagcaaaaattatctcaaccggcgctttgtcggggattatgcagcaaatccaagctttcaaaaatcgaaaacgaaacacagcagcctgatatcattcttgctcagactttgctccagcgcctaggtatttcggatcttgtttttacattttacgggagtgaaaaagagaacaaactgcaggaactgcagtttcgtttagcaaaaactcgtatgaaccataaaaccttacagcttgatcttgtaaaaaaaatggagatgctatgcacctccaaagatatctgctatttacaatttgctgcttacaaatcagccatctgcgaacccgacaataatcaaaaattaaaggggttaaaaaatgctctttttatgactttgcccggctttcaatttgatgaaattcttgactatcgattatcgtggatagaacttaccattttaaacaatatctgccgcacttatgcaactataaatcctacacatggcatttactgtttttataagcttctggaatataccagccatgttccgttggatgttctcgagaaaaagcgttccttccccgtaaccttgggaatgcttataagatttctttatacagaaaatcgtctttcggaaatcgttgcgttagtcccgcttttttccgatgctataagttcaatgtattttacagggaacattttttcacactactgtcaggcattaggatcacttggtctcacaaattccgcaaaggaatttgcacactatgcctattacaatgccctccttatggaggacatctacaatgcatccggtctgaaaaatgatctgaaaaaaaattacaatatttctttactataaaatttcaatattctcttctgaagaccagtagggtacaatctccttgctgcttactccaaccatggtaagcagcaagcatgccattactatggtagcaattactttttttaaattatttcccttcatttcacattctccttcgtccacttactatgtaaaaatccacacagtatatcaaatccacccgtttctcatactatataatgtgcagaatctttcattctctttcacgcttgtattcgcctttgaaatatatagtatcttacatatatagtatctcttttctacaaaaaataaaataacaaaagtggaaacatttttgtttccactttcgtaaaatcacttcaaatatttctcccacagatcgctgtccgtccggtacggttccagttcctccatcgtccactgcgtggaatcccagccgtgcataatcagtccttcatcgtaataatgataggtaagattcacataaatatcatttttgcagaggacatagttgctgtaatatctcccgtccagaatctccccgtccatcgtctgtcccgccatctgggcggtaaatgcgggcgcatcgttgaaagaatccgacttctcacagattttttcataataaacctccgcaaatgtatcatccgaacgcagtacgtcctcaacctcatatcgctctgccgtggcaagattgatgactcttgtgcgcaggtcacaaaactcgccccacatacttccgttaaaatagtgatcctgaaatgccacgcacagaatctcatcactcatatacgtgatctcataatccacataacatgccagatacgggtagtcttcatccagatacagatattcttcctgcggttccggatacatggtatccagctgcgcacaggcggcattccgcagaatctcatttactccggtcgcatctcttccatccgcataggtaataaccggatacgaaacatcgtactcctcaaatccgtctttccgctgattcgggacctcgatatgctgtgcggtaaccgtataggaaagttgatctgccacataaatgtcatcctgcgtgacaaaaaagtcttttcccagagaatccgccagttctaatacctcacgttcctccccggtgtcttctacctccgtatcgtcctccgtatagctgccatctgccccgtctctgtacgcctccgcagacgactcattccacgtcaacgtatcctgcacggtacggttgaccgcgtgaaaaaggatgaacgaaggcacggtcacaagcagcacggcacaacctatgatcgccagcacaacccacagcagagcacggctctttttttgaggtgctgtctgctgaccgtaactctctccgtacccctgtccatatcctgtgttctgataggactgctgaccgtaactctgtccgtagcccatattctgattctgctgctggccgtagccctgtccataccctgtgttctgatattgctgctgaccatagtcctgtccgtagcctgtgttctgattccggtacgcctgcggctccggcgtaggctgctgctctgtcgcaaacgactgctccggcgtaggctgctgccctgccgcaaacggctgctgccccggcgcggtctgctgccctgccgcaaacgactgctgccccggcgcggtctgctgtcctgtcacagacgactgctccggcgcacccgctgtcgctgtatactgcatccacttctccggaatctttatctcttctcttgcaatactgcgcccgacagtcgcaaactcctccatctcgcgcagcacttccgcttccagtccccgatgctggaaattcagccctgcgtagagaagcgtgaccgcacccgccgcatcgatcgcaccgacggcgcacatctggtcattgtcatcaaacgctccaaataaaaagagcttatttttacatgattccacccatagatggtcttcatctgcatagcgtttgaaatcctctatctcttttggattcgccacatacggctgctccatcctgctgtatgtctccatcaccagcgctgccgccggtcggagttcatacgcatacaactgtctgattttcatttttaccaccactcctcattttcttctttctcttttatactatcatacctggcagcttcccgccacgacttttctcacctgtttctgacacgcaccggcgcactcaaacggtatgtaaaaagaatctcgcttgcgagattctccgcgcgcgagcggttcgcaaagcgatattttccttaccgcgagctgcgcatcctcgcggagcgttttttatttcataggaatgttctgctttcacatattaatatatcacggtatttcctatgaaacaaaaaaatcccctctccgccggcaatccggcaaagaagggatctgtcctaacctgacttcttaattgcgttcatgtaagatggattacataatcttgcggaacagctcttttaaatcctccaccgatgcatccttcggattgcccggtgcgcaggcatccgcatgcgcggactctgcaaggaaatcaagatctgactctttgatagcttccagttttgacggaattcccacatcctcggagagctttctgactgctgcaacagcggctttccggtactcttcctgcgacatggcatccacaccttctacgcccatcgcccgtgcaatttcacggtacttctcgcctgtgcagtctgcattgtactccatcacaatcgggagcatcatcgcacatgccacaccgtgcggcgtatcataaaccgcacctaatgtatgtgccatggagtgggcaattccaagaccgacattggaaaatcccatacctgcgatatactgtccgagtgccataccctcgcgtccttccggcgtgtttgccaccgcgccgcgcagagattttgaaataatctcgatggcctttaaatggaacatatctgtcatctcccatgccgccttcgtcgtgtaaccctcgatggcatgtgtcagcgcatccattccggtcgatgccgtcagccccttcggcatggaggacatcatttccggatctaccacagcaatgatcggcatatcatgcggatctacgcatacaaactttctctttctctcaacatccgtgataacatagttgatcgtaacctctgcagcggtacctgcggttgtcggcacagcaatgatcggcacacacggcttcctggtcggcgcaacgccctccaggcttctgacgtcctcaaattccggatttgcgatgataatgccgatcgcttttgccgtatccatagaagatccgccgccgattgcaataatatagtccgctccggattttttgaacgcagccacaccggtctgcacgttctcaatcgtaggatttgccttgatgttggaataaatctcgtaggaaagccctgcctgatccagcagatccgttacctttgtggatacctgaaacttaatcagatccgggtctgagcagacaaatgcctttttgtagtcgtgcgctttcgcctcattcacgatctccgcaatcgctcccgccccatgataggatgtctgattcaacataattctgtttgccattttttgttcccctttcccatacataatgatctttgatcgtattttaacaacacaatgtacaaaagggaagtgacagaatccgggaagtgtaactatttatcacaatttctatttcaaaatcctctattatcaatacaatatttctaattgttcaaacaactcgcttattttctcgggcatcgccttcaccataagttctgctaagcgctccggcggcatcttcgtcccctccgtcacccatttcactgtcatatacacggaactctggcagtacatctcgagtaaaaatccaatctcctcatcaggcattttccctgttttctgtcggatcagatcctcgtaaaacgccagaatcagcctgaaatcatgatctttgagattattctgatccgcagacttaaaaccggcggaaaaaaagacccgctcttcccgaatgtagataaattttttcacgagactctcataaatatttttcccgctccccatatgttcaaaagacttgtgaagtaaaatatcaaaataccagttgatcagatcgtacttgtcaataaaattgcgataaaatgtctgccttgtaacaccgcacaattccgtcagctgtgtcacggtaatgttatcgaccggtgtcgtcttcatgcattccttcatcgcctccgccagacggtattttgtgcgggttccctttgtcgtcgtatccaccttccgtctccttccgcttcgcgtcctgcgcttctttgtccggttaaatgcctgctcttttgctacagttcctgtccatcgtccgtttccgtattttcgtcccccaccggatcaggcatctcatatccgcccgtgattccctcctgtgtgatatgatatacggtaattcccgtcactaccgccactgcgaaggcgatggttaccgcagtaagccaaagcaccacccgggcgcttaccttctttttcggataagtgatctccggctttgtgcgccgcggctgcgccaccggcacaccaccgccctgcgcggatgtactgccgcttcccccgatatttcccatgtatccctgggtcatcggaaccgaccagattcttctctccaacggcacgtacattcccgccggtgccccctgaatcagcgtaaatcccgtgtggtaaaaataattcgctgctgacggcgcagcctgcaccgtcactcgcccgcactgcaatcgggatgccgcaaagttgcacatccggtccaccagattgctgccgatccgtcttctaaaatactgcggtcttacatacagcgctgtgatatgtccgacattctgcatggcactgacgccgcacatctgcccgttttcaaatgcgccccataaaaacagccttcccgccagcatctcctgtgaaagattgggcagattcatatagtcataatactgctgcacctccgccgcatttcttgtatacggacgcacacactgctcatagacctcatgcgccgtctgcaccgcccactgtatctcatttccgtataataatcgaatctccatctgtatctgctcctctttcacaatgcccgatccatagaactcttccatcacattttaactcattctaccatgaatctgaaaattcaacaatatccgggataccggcagctgcacaggaagcaccgcatcctctggagtgaaaaaccgcgcgagtccgtttccggctctgcgcggtttcgtttcatcctatagtatatggtaagcttgcttctaacgcgtctactattcctcttcttcctccggctcgtcttttgcccagccgtacgcatacttgactgccttattccagcccttgcgttttgccttgcgctcttcctcctccatctccggggtaaagatgcggtcgatcttctggttgttgaccacgtcctccttatccttccagtatccgactgccagacctgccagataagcggctcccattgcagtcgtctcgacgcactgcggacgcttcaccggcgcattgatcatatccgcctgaaactgcatcaggaaattattcgcacttgcaccgccgtcgactttcagggactttaaatcaatgccggcatctgcacgcatcgcatcgatgacgtcgcacacctgcagtgcaatcgattcgagcgtcgcgcggataatgtggttcttgttcgttcctctcgtcaatcccacgatcgtgcctctcgcatactgatcccagtgcggcgcaccgagtcccgtaaacgccggaaccacatagcagccgtgtgttccgtgaaccttcttcgccatatattccgaatccatggaagaatcaatcatcttcatgttgtcgcgcagccactgaatcgcagcgcccgccacaaagatggaaccttccaatgcgtaattcacctttccgtcgagtccccacgcaatcgtagtgaccaggccattcttggaaaataccggcttctctccggtattcattaagaggaaacatccggtaccgtaggtattcttcgcctcgccctcgtggaaacaggtctgtccgaaaagcgccgcctgctgatcgcctgcagctcccgcaatcgggatcgcatctcctaaaaacgaaggatctgtgtagccgtagacttcgctggacggacgcggtgtcggcagcatgcactccggaatctccagctcctccaggatctccttgtcccagcacagatcgttgatgttgaacagcatcgtacgggatgcgttggaataatcggtcacatgcaccgcacccttggtgaacttccagatcagccaggtctccaccgttccgaacagcagcttgccctgctctgcaagctctctcgcaccctcaacattatcgagaatccacttgatcttcgtcgcggaaaaatacgcgtcaatgatcagtcccgtcttctgacggtatgtctcctcgagacccttcgccttcaatgcatccgcaatgtccgaagttctgcggcactgccacacgatcgcattatagaccggttctccagtctccttgttccagacaatcgccgtctcacgctgattggtgataccgatcgccgcaatatccgccgccgtcgcgcggatcatgttcatcgcctcaaccgccacgccaagcattgtagaccagatctcattggcatcgtgctccacccagcccggattcggaaaaaactgccggaactctttctgtgccatcgaacagatctctccctgctcgttaaataaaatacaacggttgctcgtcgttcctgcatccagtgccatcacatactttgccataccatgttcctccttgtttgccccttattgcttatttatgcttccctctattgtgaaatccgttcctgccccgtgctccccatgcgcagcgcataaaaaaaggagacatcgtcataaaacctgtaagcacccctcatgtgcacaggaattaaaatcatctccactctcagatcccacaatatctaattatattttacaagagctgtgcgtttccactgcttcatgtataggcatattataccataccgcaatgaaaacgcaagctttttttgacacatttactataaatctacaaaatcttgctgaatgccagcaccacaaacagggcgccgccgatccaggagtaatctcttttgcaccggtccgccgcatatttcccgacagcgcttccgccaagcaccgcaagtgcactgaataccagattcaggcataccgtgccggcaatcgaaatatccagaaacgccgcccccagaccgccgaaaaatccgtccaccgacatggcgagcgcgaaacatattccttccgtcactgacatggtcgcagagcaatccctatctgccgccgccggattattgtaaatgctgatgataaaattcagctgtgaaaatttcatttttacctgcttgcacaggaaatggtgtctcctgatatacgcccggattccgtactccgtcagcttataagcgccgaccagaaacaatcccgcaaaacacagatacgccgcatatttttccctgaccactccatcgatcagttttccgcacactaatgaaaaaaacagcactccgctgcataccgcgccgatgcagagtgctgtcttcttttcgatccggatctgttccgccccgcacgccacggatgccagaaagacgtccatagagagcgctacgatcaataaaactgtctgcacatttttcctcgaaacggctttctcattctatcttattcaaatccgcggctgctgccactttgtattccggatcaccgttccgcggctgctgccactttgtattccggatcaccctttcaccgcgcccgcagccatgccgttcaccatgtccttgaccaggaaaaaataaagcaggacaatcggcaccgcgatgaacacgcttcccgccgcaaatcttgcaaattccgtctcatcgaggctcatcagaccgaccgccaccgtatacaggttcttttccttcagcaaaagcttcggcagaataaagtcgctccacggccaggtaaaagaagagagcgcagtataaacgatgatcggccgggagagcggcagattgattttcataaaaacctgaaaattcgtggctccgtcaattctcgccgcctcgtcgatcgccttgggaatcgtatcgaaaaagcctttctgcgtcagatagcccatcggcgctcccgcactgtagattaagatcagtccccagagatgattgatcagattaaactgcgtcatcagaaggtacaccgcaatcattcccataaaggaaggaaacattccgagcaccatcgtaatcttcatcatcggtttgcgcgccgcgaacgtaaaacgtgacatggtataggcggtcagaatcaccagaaacgtgccgaggatgcagctgcctgccgccacaaaaagtgtattggcaaaccagcgcggatagttgtacagtgccgtatccgtaaacagccgtttgaagctcaccagactgtatccggccgggaaaaaaccgtcaaacgaatagatcgttcccgatttggaaaacgatgcaaggatcagccacaggcacggaaagaagaatacaaacgccactgcaagcaatatgagataggtcattccggtatcgaggattcttcctgcggacatccgccgctttttctctgtttttctgctcattgaaacgtatcctcctccctgtaagacggtgactttatgtaaaccacaagtgatattgccgatgtgataaagaaaataatcagactgatcgccgcgccgatgcagtaataattgttgtcgatggacaggttatagagccagttaatcagaagatccgtatcgctcgcaaggaaatagccgtccatatacagcccgccccgcaggaagtaaaagatcccgaaattattgaaatttccgataaactgtccgatcagcaccggcattgtcgaaaaaagcacgaacggcagcgtcagtttccggaactgctgcatgcgtcccgccccgtcaatgcgcgccgcttcatataaggaagcatcccggtttgacaggattcctgtggcgagcagcatgatctgcggtgtactgatccagcagttgaccaaaagtccgatcaggcgcgccgtccacttggcatcgagatccagaaagccaaccgcactgcccccgtgcgccacaatgatctgattgaccggtccgccgtaagaaaacatgaacttaaacgccagcagggtgataaatcccggaattgcgtatgccagcaccggaaatgcgcgccagatggcttttcccctgacgcagtctttattcaggagcagcgccagcccgagaccggcaaaataattgagtgcagtggagacaagcgcccacacgacattccatcccagaatcttaaaaaaggtctgtgcaaactgcgtcagcgtcagcagttttttaaaatttgcaagtcccacccagtccacgagttccgggggtacaatgtctccgccatagttcgtaaatgcaatcaggatcatgaacagaaccggcaggatctgaaagatgaatacaccgatgaccggcagcgcgagcaccgtgacatagaactttttgtcgagcagctgtgccgcctcctcgcggaaggacaacacgcttcttccctgctcgatccgcttctgcatccggtaggtgtcgcgcacgtttccacagtagatacacacaaacgccgccagaacgatccacgcaaatattcccatcagcagcatgacaaccgagttatctccctctacgccaagccatgcatcccctctggtcgtacccagtgtaaaaaaaccggcgagatcacgacacccgcgcattgccatatagcagatcatcaggacttccgccaggaaaaagcacacgccttttccctttgcgccatagcggaactgccctgcccccatgatgaccattgataattttacgttcccgctgctgtcaccaaaccaggcagcagcacgctttattttttgcttcataccgttctctccatatctgctactttaacgtatatattgcgtcatggatctgtgtatccacctgttccagcccgctctttagcgcaggcagatcctgatactttttcccactgccgcttcggaacgcgtccttcgctaaatctgtaaaaaaggtctgtgccggcgtccagatctgcgacacctcggagatggacggcatcagcaccacatttccgttctcgagatttgcatagattttctccgatatgtcccccgcactctccgccgcatcgccgcgcgccggtgcaattccgagcatctcgctccgtctggtgaccatctcatagcttgtcgcaaaatcaataaatgccaggcaggcattcggcgccttggtgtacgcgctcactgcgtatccgttgactccgcccatcgctttcatatcgatcagtaccggatcgctctccgacagatcgccgctttccggaagcttcggcagtgtcgtcatgatcagattctgctttgctgtctccctggcttcctcctcgttcatgccctccgcctcgtattctttttccagttcatctgcgaacgtggagtacatatccggtgtcgagagcgtcgcaaaataggtgccatcccccagtttgctgtatgcgttggttgtgatcgtgtcgtcgatacattcctcgttcatcacacccgcaagctgctgcagaacccacgcgcctttttccgcctcgccggcagaaaatccgacgtcctccgggttcgtattctcctcgccgaacacatagccgccgtaggaaaataagaatccgctggaaaaatacacatcgtacagcgacttcatatacccgtactgcgccggattttcttcatggcgttctttggaatatgcatacagatcgttccagttctccaccatatccggcacgccgttctgatcctcatcccagttctcctgccagtcctccggcagcagatccgcccgatagtacagcatcggcgcctgcacattgaccgggacaccgcagcagtaggtcgtgctgtccacggtcgtctcatatgccttccacgcgctctccggaatctgctcatagcaggacagctgctgtaccggaagcggatagatatgttttcccttggcgtactgcatgatgacatcgttcgcctggtataacacatccggtccatagccataaggtccgtcatttgccagatccaggtactgatccatgttggcatccaccgccgtgattccctgatcggcgtacgcctcattgaatgcggtaatcagctcctcaaaatatcccttggaaatggcggtgtcattttccaatacccggatcgtgacattctcctccagttcaccgtcaaaaacactgcttccggataccgcggcagcgctgccgctctccgtcgtcttctcccccgtcgtcttctcatccgcacatcctgctgccgcaaggacggctgtcagaagtaacagtgccacctctttttttcgtttcatctgcttcctcttttctgcggaatttccgcccatatcaatccaacgcttccctctgctctctcacaatcagatacccttccggctccacgcagacgccgcaggtcattttcccatcaccagctgccggaagaaccgatgcccggtgagcagaaagcaccttgctgtccgctttcaggcaatgctcctgccgcctctgctcctccgtcatattgatgtacagcgatacgccctcgcccccggccttccgcctgacacagagcatcccgttttccgctgcaagctccacatttccgtcggtgatcgcggtgcagctgcggatatgcgtcagctccgtcagcttctttcgcacgtcggtatcggtgtgcaccttttcccagtcaaagcatctgcgggaatccggatcatagccgcccggcacgtttttgtgtcatagaaacgaagtttgctatgacacaaaaaaatccaccttcctaccctaaataggaagatggatttttcttacatctgcagcagatattcgatcagtttatgtccttccggaataaagttggctgtctgcgccgcctcgcgctcattgtaatgccagttctcactgcgctctgccgtgctgtcatagagcagatacggtacattgtccgccgtgtgtgtgcgcagggaaatcggtgtcggatgatccggaagcaccaccatgcggaaatcctctcctgcctccgcaagtccctcggcgatcggccggataatgcgctcatccaggcgctcgatcgcctttaccttcttctcaacgctgccctggtgtcccatctcatccggtccttccagatgcacgtagacaaagtcatatccgtccttcgtcaggacatctaacgccgcgttcgcttttccctcataatttgtatccagaccgccgttcgcaccgtccactgtgatgactttcatggaagtgccgaccgcaattcccttcagaagatcaactgcagaaatcatcgcgccctgtttgtgggtgcgctccgtaaacggatagagtgccggctttgtgcctgcgccccagaaccagcaggagttcgcaggatttaatccctttttcttacgctcgatgttgatcggatgattcacgagaatgtcatagcttttcttcatcatggtgcgaagcgcttcgttctccggaagcttgtctccgatcttctgtcccagcacatcgtgcggctgcaccagatccaccacctcgccgttctcccagatcagacagtggcggtagcttgtgcccacataaaaatgaaaaatgtctgtctccagttccttcttcaccgcctccaagagcactgcacattcctcggtactgatctcacccgaactgtggtcgatgatcgtacggtcctcgtaattgtcctcctcggaaagcgtgacgatgttgcagcgcagagccacatccgtgtctttcattggaacaccgatagagagtgcctcaagcggagaacgccccgaataaaattctctcgggttgtatcccagcacggagagattggcagtgtcgctgcccggcttcatgccgtccgggatcgtatgtaccatgccgatctcacctttcgctgccagttcatccatctttggtgtctttgcatactctaacggagtcctgccgcccagactctcgatcgggcggtctgccatgccatctccaagaattaccaaatacttcatctcacacttcactttctgctgttatcagcctgctgtttcacatcggatccctgttttactgtgccacgcggatcatctgaagtacactgccaagctccgccgcctttttctcataatcagcttcgctcatgcgcgccgtcacaaatccggtctctccggatacgccttccgccgttacataactcacttcaccgaagacttcttctatgcgcttctcatctgcggacgtgcgcacaaaatagcagttctcgacgttgcggtaatccaccagttccagtttcttagagctccactccaccgcgatattggtgtccagatgcttcgccatatccacgatatccgctacaaccgcgctcgccgtcgggagcttgccggcgccgcttccgtaaaacatggcatcgccgagcacattgccgtgtacaaagatggcattgaacacatcgttgacattgtagagagggtgtgtcgccggtaaaaggaacggcgctaccatcgccacatatccgtctcccaccttgtggctggatgccaaaagcttgatggctctgcccattgtcttcgcataccggatatcggtcgctgtgatcttcgtaataccctctgtgtgaatatcctcaaagtccacctgctgtccgcataccagggatgtcaggatggcgatcttgcggcaggcatcgtatccttcaatgtcagcggtcgggtctttctccgcataacccttcgcctgcgcatcctttaacacatcgtcgaactccgatccctcctcggtcattttcgtcagcatgtagttcgtggttccgttcacaattccggtgatctcctcgatctcatctgccgtcagacaggaattgagcggccggataatcgggataccgccgccgacgctcgcctcgaacatgaaattgacatttttcttcttggcgagtgcaatcagctccgcaccctttgccgcaacgagcgccttgttggaggtcgtcacatgttttcccgcggtaagcattgcctttacgaacgtgtacgccggctccacaccgcccatcgtctcgacgacgatctgcacttccgggtcatttgcgatcaccttataatcatgtaccaccttttcctgaatcggatcccccggaaaatctcttaagtccagaatatatttcacaccaatctcttctccggcacgctttgcaatgctgttcttattgatgtctaatacttccactacgccggaaccgatggttccatatcccattactgctactctgatcatactgcctccactttcgtcttctatcctattctgttcctactctcttccgaggatcttcacataatgtatccctgtctgctcctcgatgctcgccaccatctgtgtcacatctcccgtctccggcagaacatcgaccgagagtgtcagcgatgcgatcccgttgatcggaatactctgatgaatcgtcaggatattggcgtgaaactctgccaccgtcttgagcacaatcgacagcagtcccggttcatcatccagctggatgaccatggtgatcgtcttcccctttgctgtctcatgaaacggaaaaatatcatccttgtatttatagaaagaactccggctgatcccgacctgctctgtcgcatcctgcacggagtccgtcttccccgaatccagcagccgctttgcctccacgacacgaagcagtacatccggcaccgccttttcctttaatacataatactgacctttctctttcatgttcctcataatcctctttcttctggtatccctcacgagtgtatgtgtgcagcacgctgacacttgtcctcatgaggaagataataacacaaagaggctgcacaggcaacctcttttgtgaatatccgtaataaaatttagttatggaagctattctccctttaaaacttgcggcttcctccgccgtgtgatctgccgctgctgctcgtgtgcgtcgtgcttcttccgctgtgcgaggaggaatgtcctccactgctgccgctgctcgttgagatcctgtgatgcgtcgtcgtctgattcaccagacgatcttccttgacgcgcagattgaccttggaattctgctggtaagcgtaataatatccctttccgcgcaccttgtaactgttgctgatcgtaaaataaatgatgcagccggctccgatggcgaccgccagcacgccgaagatctccccaagcgtcagaacatggtatctggaaatcttccccgtctcggagtcataattgtactgtccctctgaaatccctttttcatagtaattctccacaccggtcagcatggaatgcatacagccattgtaatcgccattgctgatcttcgcgtacgcggcatccaggatatcgtcaattctcgaatccgtcaaataacggatcgcgataccgcaggtggagatcgtgatctcgcggttatccatatcaatcagtaatgccacaccgtcttcctgttccggcgaatgttcgtcaaagaaatcatccgcgtatgcggtcgcacttttcccctgtgcatcatctgtcgtgaccgcatagacattccagccggattcttccataaacgaggcgatctcatcgtttaagtccgcgatctcatctgccataagaagtcccgcctcatcgtacacataaccatccgctgcatcctgcgccgcgtccgcctccgccgccagtgccgcaccgctgcacggaacaagacacaccaggcataccagacaccacaggagcgattttttcatcttctctaccataagaaataccctcctaacagtccgaataccagaatgccaagcgctatcaacagactggtgagcgcaagtctcgggcggtcaaccggcagatcaccgcagatatttccattctgtccgttcatggaatagtagtatacttttccgtctctgcccttatatgtaatcgtccataccgggagcagcacatacgaccagatttccttcttcggtgcaaaaaacgtattcttgaccgatacgctgttgtaaccgctgatggtatcgcgcatcagcttttcagcgctctcacgcatggtgtgctgcatcttgccctgcacagcattctgctcaatatctctgcgctccgcaaggaatccggagaggtatcccatgtgaaaatctttcatcttgtcataggcgtacggcatcacaccgctggtaagctttacattcgccttcttcaacgcgttctccgtcagattgcgaagcgacacattgccctcgcgctccaccgcataatatttggtctccgtgtactgggtattgcccgtcgtccacatgcgcacacttctcgcgtctccctgcatctttccctccagctccacgtcgtagacccagtatgggaaataaacgcctgtcatgctctcaatctgttttttgttaaaaaatgccttcggcacatatttctttttgctgacaaaatccagaaacttcttctctgcatcctctctgccgatctcaaacggaatgatcttattcggcagatagctgccttccagccgttttccgagcacgaccggattatggcagtaatagcagaaggttgccgcagtcgtcgcatccgtcacaatctctgcgccgcaggacggacagctgtaatacaccgcctcgccctccggttcgctttcccgctctcccactgtctgcccggtctctgccttctcacctgccgctgccccggctgccgcttgtgctgcccgctcctgtgcggcagcttccggctcctcaccctgcatcggcttcatcgcatcgagttcttcctgtgtgaacagcgaattacagtattcacacttatacttctgtgtcgccgggtcaaaaatcagttctccgccacagtttggacacttaaaactgataattgccatcgctagttcctcgctttcccacagttgctgcagaattttccggtgttcgtctgtccgcactcgcacgtccactcaccggataccggctttggttttccacactcgctgcagaactttccggtgttcacatggccgcactcacacgtccattcgtcagataccggcatcggttttccgcactcgctgcagaactttccggtgttcacatgaccgcactcacatgtccagcccgcctgagtacctgcccccggtgtctgtcctgccggcactgcgcctgccgctggcatctgtcctgccggtgccgcgctgccctgctgcattcctgcatttgcctgcatgtctgccggtgtctgcatcgcgccaagtccggacagcgtctggttcatggcattcattcccatgccaactcccataaagcctgccatggcaccgttcgcattgcttccggcgtcacgcacaccctccgtaatattcttgaccgccataccgcgcatgacgttgaaatcgcttccgagcattgcgccctcattgcgcatgttgatcagcttctgggactcttcgtcataggaaatgcccgcgataccgaccttctggatctccataccgcgcatctggttccaatcagcatccagaatgtcctgcatgtacttgcccagttccatcgccttggaagtcacataggaaatacgtgttccgtccgccgacatctggttgatcgccgactgcagtgcctctaaaaactctgacaggtactgctcgccgatctcatcgtaattgacacggtctttgtttctcgggatcacttccgcatagaactgcagcggattcgtgatcttgatggaataattaccgtgtgcgcgcaggaaaagctctgcgttataaaaattatcaaagtaattgatcgggtttctcgttccaaacttgatccctttgatctcctgcagattcaggaaatatactttctgtgccgtcggcgtctgtccaccgtacttgatacggttgaacgtctcttttactgattctcccagttcaccgtttagcatggacggcagggaagaattatctaccttataatatcccggttctgccgtgtaatcgactacttttcctccatccacaagcatcataaactggttgtcgtacacgtgaatcacggagccattgctcaccgtattgttcgtccccttggtattctgtcctctccggatcagcacaccactcgtaaagacggtctgttcccccatatcatccgcctcgaacacctcgagccactgatccgccagtcctccgctgatcgcactaccgattgccttgataattcccataacaattcctcctgttctattctttcgttgtactctgacgagttcttattggaagttcctgcaaaacttcatatgcacagaatcatgcgccaaaaatgtattcacacatggtgataatccacctcagaaaaacgtaccatccgccagactctggtgtctaccggtacaaccgggctgccgcagtattcacagatctgctgtccaagtcccttcatcggagccccgcagttcgggcagttcagcccgaaggcatttccctccgtctgctgcgccgcatcctgtacatagagcagctccatattgtactttgtctgcagcttccggtctttgtatccccagataattttgcccgctttttccttgtagtggtaatgctctaccgcactctgaaatgtgatcacacaagtgccgttctttttttcgtaattggaaatctctgtctgatgaatgcggatctgctcataggtctcacgcactcctgccgcacggtttccctcaatctgacggctgacctgctccttcagttcatcggaagcgcgcgcgacactttccagattccccgccgacactgcctgaagcgccgccacaagctgctgctgtgcgagcgcctcaaactgctccagattcattcccggaaaatcacgggaaatctggggtgcaaaaatccgcgtcatggaagcgaccgacttcggtgtctcctccaacatctgttcctgacgcttatattcctcaatcagaccgccttttccaaacacccactttaaggtgcggatcacatcactgctcatcgtctcctccaagtcccttcgggcagccgagggagagccacttcagatatccattcataaagatatccagctttccgtccagcacgctgtccacattaccggtctccacaccggtgcggtgatccttcaccatcgtatacggctgcatgacataggagcggatctggttgccccacccgatctccgtcacttcgccgcggattcccgccgccttctcggcattctcctgctgctttaacaggtacagctttgcctttaacatctgcatcgctttgtccttgttctggaactgggaacgctcattctggcactgtaccacaataccggtcggaagatgcgtgatacggatcgcggaagacgtcttattgatatgctgtccgcccgcaccgctggagcggtacgtatcgatccgaagatcatcgtcattaatctccacatccagatcttcctcaatatccggcatgacatcgcaggacacaaaagaggtctgtctctttcccgctgcattgaacggtgagatacgcaccagacggtgcacacctttttctgatttcagatagccgtaggcattttctccatttacctggaatgtcacggacttgatgcctgcttcctctccgtccagggagtccagcacttccacgctgtatcccttgtcatctgcccaacgtgtatacatgcggtaaagcattgccgcccagtcacaggactccgtaccgcccgcgcccgcatgaagcgacacaatggcattgtccccatcgtactcgccggacagaagcgtctttgcgcggatggcatcgtacgtcgtcgtaaactccgttagcatttcttcgatctccgggatcagcgtggcgtcattctcctcatatcccatctcgatcagtgtctcaatatcttcaaactgtgtcgtcaaagaagcatatgtggcaacatcgtccttcatgctctttaactctttcatttttttctgggagacctccggatcattccagaaatccgcagcttccatctccctctctaactcctggatccgctgttctttgtttaccaggtcaaagtgaatccctcacttcctgcagcggttccctgtatgtgttcagggtcactttaaattgatcaagttctaccacagttatcacctctttcattttttctattcttattgtactggaagccccgtcttttcgcaatcttttcccacaattttcgcagcgctgtaaaaagcagcagccagatcaccgctcccagcgtatcaatacacacatccgggaaccgtccggcgcgccccgggacagacagctggtggatctcatcggtcgccgcgtaaagcgccgcgaccgcaaccgccgaaattccgcacactttccagttaccggaatatccgtgcacaaaagcgcacgccagcagacagagtattccatattctgtcatatgcgccagcttgcgcaccggataatcaatccggtcggcatatgcttccatctcgctctgtgtatattctgttcctgtcagatgactccatgtttccacaatgcggtaggcaaccccaccgctgacctgctccgattccgatgccggctgtgccgaaaaccggaaaatcatcaccatacaaagaagcagaagtcctcctgttatcacacggtatatccgaagcttcatcccgtctcctcactccgatcagtcgttctgtgtcttctcactcagcacttcgattgccttctgcacctgattatcgtattggatctcatactgctctccgtccgggtcgagatactcatattccagttcaatgtccggatcgattccgacaccgtggatatagttgccgttcggcgtaaaatatttcgcggttgtcagcttgatggcgtctccgtcttccaacgggaacaggctctgcacgatgcccttgccgaatgtcgtcgttccgatcagcgttccgtagttgtaatccttgatggctcctgcaaaaatctcggaagcgctggcgctgtcctgattgattaacaccgccatcggatagtcaaaatgcgtgtctccgctggagcggtactcctcgcggtgtccgttcttatcctccgtgtagacgatcagaccttccggcagaatatcgtcaagaatctgtaccacggaatcgacaagtccgccgccgttatagcgaaggtcgaccaccagcgatgtaagcccttccccttccagttccgcaagtgccttctcaaactggtttgccgtatccttctcaaaagattcaatccggatataaccgatcgtatcgtttaacatctgtgaagatacgctcggcagcgtcacatcggcacgctccacgtcaaacgagagattctctccggtagacgggcggtagatctcaagatgtaccgtcgtcccggcttccccgcggatcagcttcacgagatccgtgacatccatcgtatccgcctcggttccgtccaccgacagaattacgtcttcgttgcgaagtcccgcactctcggacggtgttccctcgtaaacctttgtgattgtgacctgcatggtatctttatcctgcgcaagccctgccccgattccgtaatactgacccgtcatgctgacctgcgtctgcgcgtactcatccgccgtgtagtaaaccgaatatctgtcatccagtccctccagcagtcccgcatacagaccgtcctttaaatcctgaacatcggtatcttcataataatacagatcaacgtaagctgacagttcgttgatctttgcggttgtctttgcatccagcagggtcgttccgtccgtatctgccgctgcattggtgatgagtatctggcttccggtaaagcggcaggtcagataaatgccaagcgctccgacgaccagtgttccgcagattccaagaaggatgccggctcccattccacggcgtctgcgctcttttccgccgtccggcttctgctctccggttgtctcattttctatcatgccgttttgcatattttctctttgttcgtccatagtttccctcatttctgtatgctatccgtaataagatatgtaaaaattccctgtccaaggacagggaatttcggtcaatgcctacgtgtactttctccatcagccgcccaggtaactccacgggctgacgtaacttccatttaaagagacgccgaaatgcagatggcttccggttgaaatgccggtacttccgacttttgcgatcacatctcccgccgacacggtctgtccgggcgataccagcagggatgatgcgtgcatgtagacggtgtagagtcctccgccgtggtcgatcatcacataattgcccgccgcactgctgtaggatgccgctgttaccgttccatccgccgccgcgataatgtccgctcccgccgatgctccgatatcaattcccttatggttcgacgacgctcccgacatcggggatactctcgttccataatcgctggtcacccgtgtgctgctcgggcacggccaccggaacgctcctccggtatacggatgttcctccaccccggctgccgctttctccgcttccgctctcttgatcgccgcaatcagttcttcctgcgcctgaatctccgccgcataatagtcggcgtcgctctgcgcatcttcaatatctcccgagatgtccgcaagctccgactccttctgccgcatcatagcggcaacagtcgctttattgctctcgaccgtcgacttgagtgcctccagatcagtatactcctgctccagctgggcttccagattcacaatcgactccacggtgtcctggtactcggtaagcttttgtctgtcatagctctgtatctgtgcgatataatctgcggaatttaaaaattcagaaatgtttctggaagataaaagcgcctccagataagaggtctgcccgttctcatacatgaactggatccgcactttcatatccgcgtactgctgtgcttccctctctttggctccggcaagctcgtccttcgtctcctggatatcctcgctctttgccgtcagctgattctcaagatccgtgatccgcgcggatatatctatcagctgctggttcaattctgttaccttgctctcgatatcacccttggaatccctgagatcctcaatcgtgctctgcgcctctttgagcgctttttccagctgggctttctcgtcctgcgcctcctgcagggattttgtggaagcggcgtcctccgtcactttctctgtggaagccgacgatgcctggatcggtatgcccgccgccagcaccagaatcagtccgagcgctgttattcttcgtatcattgtaaacttcatgtgtttcctgtatggcatcttatcattataccctcaaatgcttgcgaattgtgatgcggcttccgataaaaccgattcccacacccagaatcaatgccaccgggatcagattatggaaaatctcgttcacgctaaggaacttcatcatattgctgataaagctgaacttatcgctgatgtacattacaatcttcccgtacaatgcgtacagaatgccaagcggaattgccgctccgatcagtccgattacaataccttcgaccacaaacggtgcgcgcacaaaataatccgtcgctccgatcagcttcatgatcgcaatctcttccttgcggacggagatacccaccgtgatcgtattgctgatcaaaaagacggcaacaccgagcagaatcaggatgacgcccgccgagatgtacccgatcagactgttaaagtcggtcagcgtgttggccacctgctgggactgctttacttcacgcactccatcgacggacttcaggtaggtaaccagcgagtcctgcatcgatatatcattcatgtagatggcatagctcgcggaattcgccagcgggttatcgccagcaaaacttgcagccgccgcttcatttccctcaaagtacacttccttgaagctttcccatgcttcatctgctgagataaagtcataatgtgatacttccggtctctccgaaatcagctccccgatctcctcgatccgctgatccgagattccctcatcaaacagcaccgtcactgccacgccggactccgcatcctttaccatggactggaagttcacgacaatcatatagaacagaccgaacaggaaaatgcatgccgtcatcgtggcaatcgacgccagtgagaacagcttgttcttccagatattcacgattccctgcttaattgtataaaaaaacgtactaattcgcatagtcgtcgtcacctccatcatccaagaaatcatcaaacagatcatcgtcctgttcgacagaggtatccttaccgtaatgatccgaagcggtatcgtctaccacaacgcctttttgcatcgtgatgacacgcttattcattgctttcacaatctccagattgtgtgttactacaaccaccgttgttccctgctcgttgatctcctccatcagcttcataatctcccatgcattattcgcatcgagattaccggtaggctcgtccgccagcagaatcttcggcttgttaatcagcgcgcgcgcaatcgccacacgctgctgctcccctccggaaagctgtctcgggtatgagcggtattttgccgccagtcccaccatcgacaacagttttggaacatttttcttgatggagcggttggattcgccaatgaccttttgtgcaaaagctacattgtcataaatatttctatcctttaacaatcggaaatcctgaaaaaccaccccaatgttgcggcggaatttcgggatttgtcttcgtctgattttatttaattttctgccattgattgtaatggttccctccgtcggttccagttccttcaacaggagcttgatcagcgtcgacttgcccgaaccgctgtcaccgacaacaaatacaaactctccctcctcaatgttaagactcacgtcattaagtgcaggaattcccgcagagtacgacttgctgacatgctctaactttatcatgaaattacctcatttctgtatgcatctccgatggttccggagaatcaaatgctctgtcccatcccatatagtctactcaatgtatgcagttgttgcaatacccgtatgcaaattttaagaattagtagtccagagactccatatacttcatatattttacgaccatcagtgcgatcttgaacgtgatggcatcctcgaacacacgcagatccagtccggtgctcttctgcagcttatccagacggtacactaacgtgttgcggtggatgtaaagctgtctggaagtctctgatacgttcaggctgttctcaaagaacttgttgatcgtcgtcaacgtctcctcatcgaaatcatccggggacttattgtcaaaaatctccttgatgaacatcttgcacagcggaatcggcagctggtagatcagacgaccgataccgagtgtggagtaagcgattacatccttctcctcgaagaagatcttgccgacatcaagtgccatccgcgcctccttgtaggatctggatacctctttgatctcgccgacaatcgttccgtatgccacatgaacgtcgctgtccgcatccgcacggaacaggttgaccatgctctccgcgatcttgttcagttcctcgtaaccttcgttctcgccgacttccttcacaacgataatattcttctcatcgactgctgtgacaaaatccttcgtcttcgtgccgaagattccgcggatcttctccagttcattgccgtccttgtcgcggttcgtctccacaatgaataccacgcggcgcacctcggtgtcgatgtgaagcttcttggcacggttataaatatcaaccagcaacaggttgtcgagcagcagattcttgataaaattatccttatcgaaccgctccttatatgctaccagaagattctggatctggaaactggcaatctttcccaccatgtatacatcatcgctgtctccgcttgccagaagaatatactcaagctggtgctcatcaaataccttgaaaaactgatatccgttcaccacctggctgtctgccggtgactccacgaacgcctgcgccggctcaatgtactgatccgcctccggaaaagtggctgctaacaccttcccctccacatcaataatgcacagatctattctggtgattccctttaatccatcgattgtattctgaagtatttgatttgaaatcataagctccgctccttctcatcctgcttctgctgaaactcttctgtccggtcactgtgtttcttccctatgagcaactttcacaataaaaagccgcctttctacctcggaacaaaaatatctaagctatattttaatgcaaaacagcaaaaaaagaaagaggaaatgcattttttttatgcatttcctctttttcactccgcttccccggacttttcctgatcctgatacttgttcatactgttcttcaatcttcccagatgcagccggttcttaacgaaacttccaagtccatgcttttttccatgaacgccgagttctcccatgccgaaccatatggtcgcgctcatcttatccttatgctccgcgaaaaaatgttcctgcagcggagacggcagaatcgaaacgatcacatccggcgtcgtcgcattcatctcattgatgacggcatccagattccccacacaattttccagtgcatattctcccgccagaatcagcttcgggaatgcttcctgcagttccgctttgaccttctgcacgtcctcctccgtctgtcccagcacaaaaatgctccgcttattgcgctcgatcctccgatagaattcatatgaaaaatcattctgctccgtctcctgcacacgctgcatgctgtccgcatccgccgcctttaagatctccttctccccaatgacggaaagatctagctccgagatcacgttgtgtaccaccgggtccgtctctgacgcaatcagcatctgcatggaaatgttttcgattgtatttaaaacatcattactcagatagttctcgacctgccgcatcgattcccgcacggtatagttgtcaagaccgatccccataatatctatttttttaatcattgtgcacctatatcattaccattatttgaaaaaacataccttcgtctgcgaaagatatgtttttagtatagcaaacttgtattcgtatttcaagattcttccattccggtcaaatttacagacttcttttactgcttttttataattattttatatttgaaatgtcaataacttttccaaactttccacgaaatcggacaactttattatttcttcacaaaacagacattcgattattttactatgtaaaccagatttttttcccacttttctgtggataatgtgaataacttcgtgtataactcgatttttcctgtttttccgtttctgcattgtggataacttttttgcaattcacactcatttagtcagttttcctttttcattttttacaatttgtgcacattgtatagactgtgccttttgtcctattccttcattttttgcaataatcctgcgttttggggtgcaatattgagaaaatcatgtcccttcgttatcaggcagaatgtaactgaaaatcaaaagagcttccgcttctcttcctcttcttatgacgcaaaaatgggactatcacaagtgatagtcccattttatattctcgtttagaaaattcttcttacacagatcgggctgcggtaggtaacactggagtaagtgataccgctggacggtgtgctggcatgcacgatcgttccatttccgatatagattccaacatgtccgctgtaacatacaatgtcacccggctgtgcagatgaaaggcttacttcataaccacagcctctcaacgcactggatgaatgcggaagaccaattccaaatgctgaatacacactcataacaaatccggaacagtccgttccattcgtaaggctgcttccgccatatacatacggattaccgacaaactgacatgcatagcttgcaactgcctgaccgtttgaactggtcggtgcactgtaggatgcactggaatctgaggagctggatgaactggatgaactctcagagttcttctttctggcgctagctgccgctgctgccgccgcctcacgctctgcctcttccttcgcaagacgtgcttcctcttctgctttggactccgcctgcacatactctgtcgtcaatgtgacataatcggtggatacatagccgtctccctcttctgtcgtcacaagtgcccagcccggaatggactcatcggttaccacaaggtcatcctcaatcggaaccatggttaaaaccgctgcatctgtggacggctctgtacgcacataaagcgttgtcgtcgtaacttttgcatagcgggtacttacagactttgcaagttcctcatctccggcaaccacgtactcacacttcacataaccggtaacattgccggatgtgatctcataccagccatcctctgtggtctgtaaaatcgttgccgctgaattattgtaaagcttaccgactacctcgctctctgtgttcggctcggtacgcacgtttacatagttatctacctgcgcaatggcaatgtctgcatattcggactctaccaccggcgtctcattctcgcttacctgttcctgctgcgctgctgcttcctgcgccacttcctcattgcttgcgaccagacaatctgccactgcaagcgaaacgcctgcgctcgggctgctgcttcccgttccgactgccactgcttctgctgtggtagcaacggacacacccgcaaccggtgctgcatatatcatagatacaggatctcctgccaataacattccagtcaatacaatccctgtagctctcagtgttcttctgttcatgaatgcctccaacggatttattacaaatttgttacatttattacatggttattataacaaagcgtctatatgatgtcaacccgctatattttgtaatactccgcagattttacacaatattttctttttcgacacgtcttttccacaatctgcgccattttccgacaaatccgggttacatatgctcccagattttcccttcctgctgctgccttatgcctttccggttttatagtttgttgcatttttcataattgccattctcctccatctgtggcataataaagccatcataagaaggaaaggtgggattcgtatggatttttccaatgttgatctggcgcttggcacactgatggcctacgactccggttcttctgtcagctccggcagtctcgcctatgcagtcggcacggccgttctcagtcagtcattagacctgacccagcagatgggagcctccatgattcagatgatggaacattcggtgaacccggagctcggcggcaatatcgatatgtacgtatagggatcatgtaacagatgctctctgaaaagaaaagacgcggcacacgatgtaacagtgtgccgcgtctttttatgttccggatctcctccggcagtctcaggtattcctgttcctgtcgcagcaattatttggtagcaatcgcttcgatctcgagcataacgtccttcggaagacgtgccacctcaacgcagcttctcgccgggtacgcgccctcaaaaaatgtcgcatatacttcgttgatcgctgcgaaatcattcatttccttaataaatacggttgtttttaccacgttcgccatgctggtgcctgctgcctcaagcagatgggacaggttcgtcagcgcctgctttgcctgcgccacagatccctccgggatctcgcctgttgccggtacaaccggaataataccggatgtgtataccatgccgtttacctcaatcgcctgggaatatggtccgatcgctgccggtgccttgtccgtgctgattacatttttcatgctgtattccttctttcttatagtctgtcggtttcatctatcatagcacacctgaaacagcgatgctactataatttgcggattgcgcgctccgtaatctcgatgcggcgctccttgtacagtctgccgaccgcacgcttgaatgcatttttgctcagccccgtctcacgcatgatgacttccggtgaagccttgtccgtaaacggaagcacgcccgcgaattcctcaatcacttccatgaccttctcggcgtccgcatccatctgcagatacgccttttcccgcatcgtgatgtcaagcttgccgtccggcttcaccccggtgaccttcgcctcaatcacatcgccgatctgaagatggctgcagtcctcatgtgccggtatcatcgccgagtagcaatcatccactgccacaaacgttccgaaatcatgaccgaactcgtagatccgtccgtttaccgtgtctccttttttataaggagaatccgtgcgcatcaggtcgtacagctttttcatgcttgcacagagtctgcggctcttatcgatgtagagcgtcaccagaacctcatcccccggctgcacctttttcgtcatctctttatatggaagaaacaggtctttttccagtccccagtccaggaacgcaccgatttttccaatctcggcaacctcaagcaccgccagtccgccaagcgtaagtttcggctggttggtcgtcgcaatgatgcggtccttggaatccttgtacaggaatacttcgatctcatccccgagctttgcgtccgccggcacctgcttctgcggcagaagcacacgcgtctcatctccctcatgctccgccagatagactccaaattctacttttttgatcacttttaacttctgatattcgcctaatttcatctcgatcctcattttccatcaattcttctctgccgccgcaaattccacgatcgcatagatctggtctccgccgtcagtcagcaccaccgttatcttttcctctgccaccgcaacaaccggatgcagcacgtcgcccagcattgccgcacgtcggtactctgcccgcacgccgccgattgcaaaatcctccggcacagattcctttgccaccagaatgtatttcccgttgttcatgtggtggttggtgtcaataaaaaatcccgccaccggaaccggctgcatcgcagttccgccctccggaaccgatagctttctcgcgccccactcgcccggcagttcttctccgatctccggccggtaggcatccgccactttctccgggatgcgcatcgggcgcatccgctccatatccatgtatacccagacagaattcgccagcaccagttcctctccctgtccgttcgtgatccggaagttgcggtatccataaaatcccttaaatgcatacggccatgtctccacgcagattttctctcccataaccgggtagcgtctgatcttaatctcccaggaagacaatacccacgcctgcttctgctctgccagatattccacgccgatgtccatatcttccgactggaacgtgcagcaatcctgcagataatccatcaccgccggcagtgtcaaatgccgttcgctgtccacttcactgtaacgtacgcgactttcaaactgatacatggagtcccttctttcaatgcctgtgtctgttattatcgtagtaatagtaacacaggggaacaggtttttcaatgacaggaagcagatgccggataaagaaaagacctcatgaacgatgttcatgaggtcttagaagcagggctacaaggattcgaaccttgaaatgacggagtcagagtccgttgccttaccatttggcgatagccctaagtgctgtcaacaaaagctattataacaggtcggcagaaaaaatcaagtgtttttttcaaaaatttcgatttttttgtctacgagtgcgtacaacaccttctcaccccaggaaatccgggcgcttccgttcgtcgcctccacaatttctttttccacttcctgctgctgttctgccggaaccataagctgaagtttcactttttctgtatacacggtgtcgatcagcgtgaggttctgctgcgcgatcagatactgcagctttccaagcccggtatagtccgtgcctaccgtaagctgtatgccttccttcttatctataatggtactcgacgcaagccccgcctgcacggctccctgatacgcccgcaccagaccgccggtgccgagcagcacgccgccgaaataccgtgtaaccacgaccgccacgttgtgaatctcctcccgcagcagcacatcaagcatcggtctgcccgccgtctgcgccggctcaccgtcatccgaacagcgacttaactcctgccggtctccgatcacaaatgcggaacagttgtgtctggcgtcccagtattttttcttcatctccgcgatgaatgccaccgcctcctcctccgaggcaaccggccggaccgtcgctataaatctggacttcttttctacaatctcaccctcgccgccgatatacactgtcttcatatgatccacaatcccgccacccgggtcctttcccttcgctttccactcttttcaaatagtaacacggcagctttcttttttgcaatacgaatccttaagaaactgtgaagaatgtccgtattttcagttttttctttattctgacacagttctttggtataatacattgatggtgaatcagaaaaggaggcctactatgaattatggaaagaaacgtactcggaagcgcgagcatgaacttgcttccaagggtaccatgattcgcaaaaaattcaacgtaattttttgtaaggcattgcttatatgcttttttgcagtcgtgattgtcggcggatgctccgcgttcggagtgatctccggaattattgcttccgctccctcaatcgaagatatcgatgcaaccccgactggataccttacgaccgtgttggacaaccagggcaaccagaccgcaacgctcgttgcatccggttccaaccgtaaatacgtgacgatcaacgagattccgatcaatctgcagcatgcttttgttgcgatcgaggatgagcgtttttacgatcacaacggtatcgatctgcagggtattctgcgtgcaggattaaaaggcgtcgcatccggttttcatttttcggaaggcgcaagtaccatcacacagcagctgctcaaaaataccgtgtttacccagtggacaagcgaacagtccatggcggacaagttcgagcgaaaattccaggaacagtacctggctctccagctggaaaaggttgtggacaaggactggattctggaaaattacttaaacgctatcaatcttggtcagaatacgctgggcgtcggcgtcgcatcggagcgctatttcggaaaagatgtctcggagctgacactttccgaatgtgccgtgctcgcggcgattacccagagcccgagctactacaacccgatcacacacccggatcacaacaaagaacgccggcagaaagtcttgaacaacatgcttgatcagggctatatctcacagaccgagtatgatgaggccgttgcagacaatgtgtacgaccggattcaggtcgtcaatgtagagtcgcaggatgagaatatcaattcctattttgtagatgaaatgacggatcagatcgttcaggatatgatcgaccgtctgggctacacggagacgcaggcttacaaagctctctatcagggcggacttaccatcgagtccacgcaggacccggatatccagaatatctgcgatgaagaggtcaacaatctggagaactacccgaccgatccgaaggtatccttctcctaccgcgtatcgatccagtccccggacggcaccatctcaaattacagccagcagacgatgctttcctattatcagaagtcaaacaagaactacagcatcaactttgccagcgaggatgacgcccgcgcagcgatcgagcagtataagatggatcttatgcaggacggagacgtcgttgtggatggcagcgagacgcttacctttaccgtccaaccgcaggctgctttaaccgtcatggatcagtccacaggagaagtgaaggcactcgtcggcggacgcggcgacaagacggccaacaagacgttaaaccgtgcaacggacaccacaagacagccgggttctacctttaagattatcgctgcctatgcacctgcactggacgcgggaggtctcacacttgccgatgtccaggatgatgcgccgtacaattacggttccggacagggcggagcggtaaataactacgacaagcgctaccgcggtttcaccacactgcgcgaaggtatcattgattccatcaacgtcgtagcggttaagacgctggcgcagatcggtccttccctgggttacgattacatccgcaactttggttttaccaccgtcggcatcgacgagagcggcaacgagacactggcactcggaggtctcaccaacggtgtcaccaacctggagctgaccgccgcttacgccaccatcgccaacagcggaacctacatcaagccaaaattctatacaagaattctggaccatgacggaaatgtactgcttgacaatacggcaccggaatcgcacaccgtcctgaaggagaccactgcatggcttctgaccgacgccatgaaggacgtcatgacacagggaaccggtacgccggcctacttcggaagcagtatggcgcaggcaggaaaatccggtaccaccaccaagaaccgtgatgccctgtttgccggattcacaccttattacacctgcgtggtatggggcggttacgacgacaatgcggttcagaacagcggacagaccacctatccgaagaagatctggaaagcggtcatgagccggattcacgaggatcttccttatgcggactttgaaaaaccggacggcatcgtcactgctaccgtctgcaaagaatccggaaagcttgccatcgacggcgtatgtacgaacgatccgcgcggcaacatggcatataccgaatattttgcaaccggcacggcaccgaccgattactgtgaccaccatattctggccaacatctgtgcggattccggacaactcgccggcgcaaattgtccgaacacctacgcaaccggcgtatacgtgattggcggctctgcgaacacagaggatgctccttatcttctgaccgaagaggctctcgccaatacctgtacgatgcacaatgcaccgtccacaccgtatgagtcgacgccgtacacacctgttccgggcgtgacggatctcccgtcgcaggataccaataccggaaccacagacaacagcacctccccgggtgacagcggcacatcgacgggtgagaatcagaccaccggtgacaataccggcggctctgctgagaataccggcggcaacgccgacggcagtcaataaaaagatgcgcccgggttttgaaactctcaaaacccgggcgcatttttttatctgtcatgttttaattctctgtaaaggatcttaccgtctgcagtacctcctccgccttgtccagcgattccgctgcatgttctccctgctcactgcaaaaatcgatggttctcgcctcaatacgctccagatgccctctggcctccgcgctgagtgcctccggcgtgtattctttgatcgtaagtcctgccagccgcttcatataacgattcgtcgtctctctggcctggcgctgactgcgcatgcgctgatccatgatctcaatctcgcgctcctgcttttcctgctcctgtctccgcgcgcctgtatcctcctcatttttgacctgcacggcatgatattcatacgcctcctcaagcgcctcccagaatgctccacggaagtctaccggacgtaaaaatacacggaatacattccgctcgttgatgaagaaatgaagctgcgccgaactgattgtggtcgtatagatgatacaaacggtactgggtgccgtcttgttcagatacgttatgatctgctccccgttgtacccctccagggatagtcccgttatcacgatgtcgtaattctttttcttgatctttgccgccgcctctatgccgtttatcgccgtctcaatctcaatatcccgatccttcatcgcatctgtaaattcatgaatgatctggggatacttgctgatgaacagcagattatgctttgtatcgtcctgtcccatatcacattcctcctatgtcgttgcctttacttcttccacaggtctcaaattatttttccaaccctatatatctgctgatatttcccacactacttttcgtttattttcttatcttgaattataatggaatgtccccaactattcaatagacttcttctccactttctccctcagatattctatccgcaaaactgccttcgcagattttttcttcgtatttactgtacaatcacaatttatggcctttacagtcaaaaacgcgaaagcgcccggcaatctgccgggcgttcccgcgttgatgtatatactaactaaggggattagattcaccaatctaatcaaattagattagtgcatattagtgtaactctctggatacgaaatccggatagccggactctaatccatgctctgtcgagtcaagaccctcgatctcctcctctgcggtgactctgagaccgatcgttttctttaatacggtaaacacgattgtcattgtgatgatcgtccatcctgcgatgcagaggattcccaggcactggatggcaaggtgatgtacaccgccgccgtagaacagtccgtccttgtaatcaaagaatcctaccgcgagggtaccccagataccgttgcagccgtgtactgccactgcaccgaccggatcatctactttcagtttatcctcaataaagtatactgccacgcagacaagcacacctgcgactgctccgataacaaaagctccgattgcatctacgttcgagcatccggctgtgattgccacaaggcctgccagcgaaccgtttaaggacatggacacatccggttttccgtttctgatccaggtataaagcattgcggttacggttgcaactgccggtgcaatcgttgtggttgcaaaaatctgtgacagctgcatggtgtcggttgctgctgcgccgttgaagccgtaccagccgaaccagagaataaatacgccaagggcaccgatcaacaggttgtgaccgagaataggcttcggcttgccgttcttgtcatattttccaatacgcggtcccaacattgccgcaccgatgaaagcagtgataccgccaaccatatggatgcaggcagagcccgcgaaatctgtaaatcccatgtcggtcagccacggtgtaccgccccatacccagtgagcttcgatcgggtacacacataagctgatgataaaactgtagatacagtaggtaatgaactttgttctctctgccatggcaccggatacaatcgttgcagcggttgcacaaaataccaggttaaacacaaacgccgaccagtcggtctcgccgaaattcgtaaacgggttcagtccccagccgacaaattttccatcgccgcacaaaaggttgtaaccgagcagataaaacgccacggttccgatacagaaatccatcaggttcttcatcgtgatatttccgacgttctttgctctcgtaaatcctgcctctaccatggcgaatccacattgcataaaaaagactaacgctgctcccataaggaaccatacactcatatccataagcttatcctcctgcaaaaaaagaggataacagcgagcacagacattcctgtgttctctattatcccctttgataatatgttacaatatttgattttttcataataatctgtagtgctccttcatcgctcctatagcaggctcctcaattcctcctataacagcactcctcaaacaggcttacaatgctttcgtgccatgctcacctgtacgaatacggattgcatcttcgacatcatacacgaagatcttaccatctccgaaatgtccggtgttaatctcatctacgatcttgtcaatcagcttcggtgcaacttcgtctgccacaaccgtctcgactttgatcttcggaagcagattcacggaatactctgcaccgcggtagttcttaataattcccttctggttaccatagcccatgctgttgacgatattcaaaccgtttacttcctcggtatccagcacgccctttaagtcttccagtttttccggcttaataataatttccagttttttcatgccaagctcctcctttatattcagttttagcgaaagcgctactcccatccctctgctgttcacagtttattcatttaagattcaaaaatctttcatcctgtaaacatgaaattttcatttctgctccatatactataaccatacaaatgatagttatcagtatttgttactacccacaaaactttttcataatctgccaggtgacggttgtcacctggcaatcctcccctttcggggagttttttctccctttaggggggattttttatttaggaggttgatggtagcaactatacctcgaaaatcaaatctccataggacggcatcggccacattgacttatcaactaacatctccagcttatctaccggcgctctgagttcatccatcgctgtctttaccgtatctctgtagtatacagcctgctctctgccctcatccattgcagatgctttctctgtcacatcctttaacttgtcgagagcattctgtgcgtctgccagaagatcggatacctctgtgaggatctctgtctgcgcgctgatatctgcgccgcatgcactctttacggcattgatggactgtgccagtaccgttgtatatttgataactgccggaatgatctgctttgcagcaatgtcgatcattgcctttgcctcgatattgatctcttttgcataggtctcatactcgatctccacacgggaatccagctcagccttggtaaataccttgaacttctcaaacagtgtcactgccttctctgtgttgagtgccgggatcgcatctaccatggagcggatgttcggaagaccgcgcttctctgcctctgctacccactcgtctgaatatccgttgccgttgaatacgattctctgatgctcggttgcatactccttgatcagatcatgtactgccatgtcaaagtcatctgccttctctaagacgtcgcatgcctctgcaaatgcctctgccacgatcgtgttgagtaccacgttcgactgggcgatggaatcctgggaacctaccatacggaactcgaatttattgcctgtgaatgcaaacggtgatgtacggttacggtcggttgcatccttcatgaaatccggaagcgtcttaacaccggtctctaacttcttgccggagatactgtgtgttgcctcaccagtgctgatcagctgtgaaagcacatcctgcagctgctcaccaagatatatggatacgattgctggcggtgcctcgtttgctcctaatctgtgatcgtttccgacatctgctgctgcctctctcaagagatctgcatgcctatctactgcttttaagatgcaggtaaggactaacaggaactggatgttctcatgcggtgtcttgcccggctctaagaggttgatgccatcgtctgtcgtgatcgaccagttgttgtgcttaccggaaccgttcacacctgcgaatggcttctcatgaagcagacactgtaaaccatgacggccggcaactttcttcaatgtctccataacgagctggttgtgatcgactgccacgttcgcctctgcgtagatcggagcaagctcatgctgtgccggggccacctcgttgtgctgtgtctttgccgtaacgccaagcttccagagttcctcattgacgtccttcatgtatgcaccgatgcgctcacgaattgatccgaaatagtgatcgtccatctcctgtcccttcggcggcattgctccgaataaggtacgtccggtaaagatgagatcctttctctgtaaatacttctcgcggtctacgataaagtattcctgctccggtccaacggacggtgttactttctttgatgtagtatttccgaataattttaataagcgaagtgactgctcattgattgcttccatagagcggagaagcggcgtcttctggtcaagtgcctcacctgtgtaagaacagaacgcggttggaatacaaagggttgcacctgctgcatcctgtctcacgaatgccggtgatgtacaatcccatgcggtatagcctctggcttcaaatgttgctctaagacctcctgacgggaaagaagaagcatccggctcgcccttgatcaattccttaccggaaaagctcatcagcactttaccattctccatcggagctgtgataaatgcatcgtgcttctctgcggtcacgcctgtcagcggctggaaccagtgtgtgtaatgggtagcgcctttttcaatcgcccactctttcatctcatgtgcgacaacatccgctgtctcgagatccagttcttttccctcgttgattacttcctttaacttcttgtagactttcttcggaagacgttcctgcattactgcatcgttgaatacgttttcaccgaaaatctctgctgcattaaggtatcctgtttcgctcatcttctacatcctttcttctcactaatccaatcccctaagaccagacttgcttattctaatgtacgcgatttcctgtcggatttcaaccagaacttcatgtaaagttctgtatacagaaaaaagggcattccaagtctattggaacacccttgttcatcgctcacattgttttgttggtattaagataatactttttaaaacgaaatgcaagcgaaaactttatatatttttaatttttacacttctaacaaaaataataaagttctagtcaaattattgtgaaaaaattctgttgtccgacaaaacaacttcattccataaagaattagtcgtttgccttacctacggaaccgaacagctccatcttctcttttacagttgccttgattgcctctgcgccaggagcaagaagtttacgcgggtcaaagcccttgccttccagatccttgccagcctcgatatatttacgtgtagcatctgcgaaagataactggcactctgtgtttacgttgatctttgcaacaccgagagagattgctttcttgatcatgtcagccgggatacctgtaccaccgtgaagaactaacggcataacgcctgtcttctgctggattgcatccagagtctcaaagcttaagcccttccagtttgccggatattttccgtgaatgttaccgatacctgctgcaagcatatctacaccaagatcagctacacgcttgcactcgtccggatctgcgcactcgcccatgccgacaacgccgtcttcctcgccgccgatggaaccaacctcagcctcgatggacattcccattgcatgtgcaacctgaaccagctccttggtcttctcaacgttctcgtcgatcggatagtgggaaccgtcgaacatgatggatgtgaatccagccttgatgcacttgtagcatccttcgtatgtaccatgatccagatgaagtgcaaccggaactgtgataccgagctcatcatgcattgcctttaccatcgctgcaactgtaccgaaaccggtcatatacttaccagcgccctcggaaacaccaaggattaccggagactgtaactcttctgctgtcaggagaacagactttgtccactcaaggttgttgatgttgaactgacctactgcatagtgaccagcttttgctttttctaacatttcttttgcagatactaacataatgaattcctccataacttaatcaatttgccgcaatgcggcagttgtttttaccctaccgctattatatattacttcctgtaaaaaataaagttaaatttttaacaaaacatacttcccgacaaggtctctcactcgccctgcggcaccataatctcgactgccttgcacaggttcttcaccacgacctcctcatggtcgccgccgaattctccatccagcgtccacgggattgtgttcttcgccgtgaaccgcacttcgctggtcttaaacgaataaatcatgtccgtatcgtccacaagattgatcaacgatgcgatgatctcgtttaactcgatcgggttcttcggctttttgatgagtgtgacctcgaagactccgtcatccagcaggacgtcctttccggtcatccccttaaatccgcccacggaggtggaattgctgatcatcccgtagatgaactcgtcctgaagacgcacattgtcgtactctacctgcatgaggaacgacgggatgtcgtgcaggcacttcgcgccctctaagatgtaagccgcatgtcccagcacattcttccactcctgactcgtcttgtaggagacttccgtaaacagcccaaatgccgccacgtacacgaagaagtccccgttaaacgccccgatatcacacgggaacgcccgacctgcaacggctgtctccgccgccttgaccatatttttcggaatgccgagcgatgtggcaaaatcattcgtgctgcccgccgcaatatagccgagcggtacctttttctcacggtgcatcatccccgtcaccacttcatccagcgtaccgtccccgccgctgcacacgacgagatcataatcgccggcttccatctcgatcttatgtatcgcgtctccctgtgcctgtgtcggatagatggtgacctcataatccgccttcaccatcacatccacaatatccaacagctgattcttgatctgtgccttgcctgaaaacggattaaacacaaacagtaactttttctttgtacccattatttatacacccttatcttatttctttctatgagacgaggaattcctcaatcgctgcaacggcttccgcttcgtccgctccctctgcatccacaagaatctcctcaccgtttaacaacgccagactcatcatccccataatgctcttcgcattgacacggctgtcaccatgttccagatagattttgctttcataccggtttgccacctgcacgagatttgcgatcggtcttgcctcaaaatcctgctgcatctttactaccacactctttttcattgcatcctcccatcctcgctttttaacttacaccttacactgtctgctgccggaggctgtctgccatctcgctgattctgcgaagcctgtgattcacacctgattttcccacaggaggattcaggtaggttcccagttctgcaagcggcgcatccgggtattccagccgaagcagtgccatctctttgagattctccggcagatatgacaagccggccgtctctcttatatattcaatgtccgcaagctgtttgactgcagcgtttaccgtcttgctgatattcgctgtctcgcagttcaccttgcggttcaccgaattacgcatttccttcagaatccgcacattctccagattcatgagcgcaacatgcgcctccataatgtttagaatatctacaatctgcgagccttccttcaagtacacaacctgatattttttgcgtgccacaatcttggcgtccatgtcaaagctgttgattacatcccgaagctgttcggcctgtgggatactgcggcatacaatctcaaaatggtaggatttgttgggatcgctgatcgatcctcccgccagaaacgcccctcttatgtacgccctcttgcagcagttctgctgaatgaggagtcccttgaccgtatcttccggctccgcctcccccgtggcatcgttgtacattttaaccgtggaaaaaacgctgcgcgcctcctcctcggtatggatttcttctatatgaaacagttctgctaacagcagctgatatttttgcatcagcagccggttctccgattccgccgcagggattcttccctcaaatgcaatcagcgccgccagctctgcaatctggcaatgtctgctttttcccagatgttttgccagttccgtttttacctcacttgaaaatgacatagcttactccaaccgtccctcgcgtccatcggctcttccttttgtctgcggggtctatttcccgcggagcgcatctttaccgatgtcgcggtgctctattttcagtccgtatcccttttgtccggaaagccgttcatacagcgcattggcgagcgtgaccgaccggtgctttcctccggtgcagccaatggagattacaagctggttcttcccttctgcaatataattcggaatcaggaagttcagcatatcctcgagcttgtccaaaaacgtatgcgcctcctcatactggaacacatagtcctgaatctccttgtcattgcccgtctttgcccgcaatccttccacataatacggattcggcagaaaacgcacgtcaaagaccagatcggagtccgccggaatcccatacttaaatccaaacgacagaatcgtgataaacagattcttatagtcctgattctgcacaaaaatcttatccagctccgctttcagctccctggtcagaagctggctggtatctataatatagtctgcactctctttcaaaaatgccagacgctttctctcttcttcaatgcccttgtccacccggtctccgccggacagcggatggtttcttctggtctccttgtagcgcttgaccaatacagaatcctctgcatccagaaacagaatctcgtagtgaaccttcttttttttgatccgcgcaagcacgtcgcgtatctcttccagtgcctggccgttccggatgtcaataccgaccgccactttctgcagttctgcattttcctgcaggctcgacagctccacgaacttttcaagcaatgcaatcggaagattatccacacagtagtatccgatatcttccatcatcttaattgccgtactctttccggctccggacattccggtcaaaatcacgaacttcatgccagtcactctccattcctgcgtatcctgctgttatctttgtctatcgggctaaaattcgccaagcatcttaatctccggttccagcttcacctgaaactgtctgtccacctctgcgctcacatccgcaatcagcgtcctcacatcctgtgcggtcgcattccctgtgttgaccacaaatccgcagtgtttctgcgatacctgtgctccgccgacccggtatccgcgcaatcccgcatccatgatcagctttccggcaaaatatccctccggccgtttaaatgtgcttcccgcactcggatattcgagcggctgcttttcggcgcgctgcgtggcaagttccttcatccgtgcccggatggcctgctcctctcccgctgcaagcttcaataccgcctgtgtgacaatatagtgcttctttaaaatgcagctcgtgcggtagccaagctccagctcctccacggacagcacatgctgtactcccgtctcatcgagcacggtcacagtctctatgatgtcccgcatctctccgccgtaagctcccgcattcatcacaactgcaccgccgatcgttcccggaatcccggctgcaaattccatcccggtcagcgcatgtgacgcagcaagcgacgccgtgcgtgacaggagtgctcccgctcccgccgtaatccgcacgccgtctgccgaaatctcatccatcccgtctctggtaagaatgaccaccccacggataccaccatctcccaccaggaggttactgccgtttccgacaatgtaatatggctctcccgcctcccggcatgcaccggtaactgctgcaagtttctccgcttccggcgtcaccagcacatccgccggaccgcccacacgaaaggtcgtgtggcggctcatcggctcgttcggatgaatattttcttttcctgcgatctgttctaacgtatccaataactgttgtttcatgcctgttcctttaaaaatgcaatatagccgcgatatgcctcatacagatccaccttgctgatgatctcccacggtgcatgcatgttcagcactgccacaccgctgtcaatcacacgcatgccatagttggcaagaatgtaggcgatcgttccgccgccgccctggtctaccttgccgagttctgccgtctggaatgacacctcgttgcggtccatgatcgcgcggagtgctcccacgtactctgcattcgcatcgttcgatccggatttgcctctggctccggtatatttgttaaacacaagtcctcttccaaaatatgctgcgttgcgcttcgtcatcacggacgggaagttcgggtcaaatgccgccgatacatccgaagagagaacgctcgagttcttcagtgcacgtctgagtgccagttcagaatacgttcctgccgcattcatcacctctgcgaccgtattctcgaagaaacgggactgcataccgctcgcaccgacacttccgatctcttccttgtctaccagaaggcatacacttgtgatctccggcttctccatcgccgcaatcgcctcaaaggaaggatatgcgcacactctgtcatcgtgtccgtagcccataatcatgcttctgtcaaagccgtagtctctcgcttcgccggccggtacgacctcaatctccgcagagaggaaatcctcttcctctatatcatattcctttgcaaggatcttcatgatattggcttttaccttttccttgacgtcgtctttttcatccgcttccgccggaatgctgccgatgatcagatcgaggttttctccctcaatgaccttggctgcctttttctccatctgctctccggaaaggtggatcaaaagatcgctcacgccgaataccggatcacccggcttgtctccgacactcactttgaccacggtgccgtcctttttcgcaatgacgccgtgcagagccagcggcagtgtcacccactggtacttcttgataccgccgtaatagtgggtatccagcatcgcgaaatccgtgtcttcatacagcgggtcctgctttaagtccatgcgcggggaatcaatatgtgcgccgagaatattcatgccgtgctccatgctcttctcaccgattacgaacagggcaagtccttttcccatattgtttgcatatactttatctccggctgcaagctttgtacccttctccagcacggtatccagatttacgaatcccgccttctctgctttcttggcaaaataggtcacgcactcgcgctccgtcttgcagtctgacaaaaacttacggtactcctccgcaaaatcaaaaacttcgtctctcttttttccttccgggtatttctcccatgcattctttctttccattgctgttgtttctcctaacctatattgatctattcgtctttattgatctattcgtcttcctcatcgtcggacttcttcgtcaggttctcttgtacacggcggtacagctcctgtgcggcattgtaacccatcttcttctgtctgtggttgactgccgctgcctcacagatgactgcaaggttacgtccggcgcggatcggaagcgaatgacatacgactttattgccgaggaactctgtgtactcctcctcaagtcccagacggtcatactcattatccttcttccagtcttccagcttgatgaccagatcgatctgctgcttctccttgacgccctcgacaccgaacagcgtcttcacatcaatgatgccgattccgcgcagctcgataaagtaacgtgtgatgtccggtgaagtaccgatcagcgtatgctcgttgatcttgcggatctccacgacatcatcggttaccagacgatgtcctctgcgcacaagctcgagtgctgcctcgctcttaccgataccgctctctcccataatcagaagtccctcgccgtagacatctacaagcacgccgtgaatggtgatgcacggtgccagctgctcgctcaggcagtagatcagctccgccatgaactcggatgtgcttcgcttggttccgaataccggcaggttgctctcctccgcaattttgaggaacatctcgtccggctttaaatcacggcagaaaatgacgcacggaatatcgtaagccataaactcccggtaaatcgcttcttttttcttctcatccagctgttgcagatacgtgtattccacggtaccaatgatctgcacacgagactgctcaaaatgctcgaaatagccgctcagctgcaatgccggacggttgacatcacggatcatgatccgatgtccttttaattccatctgcggaataaaattgcacagatcgagaatctgcgccacttttgctacaccaacaccactcatcccttacgctcctttgtatgtgatttacttttgtgcaaattataccataggcacatggaatcttcaactaatcggacggctggttttcccgttctttctcccggaaaaaccgataaaccgagcgcgctgcctgcgggctcatgctgtccgtctgtgcgaggtcttcctccgtcgcctcccggattgcctccagcgactgatattttttcatcagcgccttgcgccttgccggtccgatatccggaatgtcatccagcacggaatgtacctgctccttgctccggagcgaccggtggtactcaatcgcaaaacggtgcgcctcgtcctgaattcgcgtaatcagcttaaatccctcgcttccacggtcgatgggtatctctacattatgatagtatagcccgcgcgtgcggtgattatcatctttgaccattccacagaccggaatattaagatgcagctcctccagcactttgagcgcaatgttcacctgcccgcggccgccgtccatcatgatcagatccggaaatcttgtgaaactgccgtactcctccgacaggtccttttcttccatctcctccatctcacgcatgccatgcgtaaatcttctcgtcagcacctcatacatggaggcatagtcatccggtcccgacaccgtccgcagcttgaacttccggtagtcactccgctttggcttgcctttctcatacacaatcatggaaccgaccgactcaaaaccgctcgtatttgagatatcgtacgcctccacgcggtttaatcctttcatatctaaaagctgttcaatctcctttaacgcgccgatcgtcctgccttcctcgcgcttgatcttctcgcgatcctgcgcaagaaccatcttggcattcttctgtgcgagttccaccagcttttctttcatgcccttctgcggtacccggatgtaaaccttgctgccccgcttctcgccaagccagtcggcaagcacctcctgctcctcgatctcctgcggcagcataatctctctcggaatgaacggcgttcccgaatagaactgctttaagaatgtggtaaggatctgggctttggtgtcctccgttccgatcttcacataaaaatggtctctgccgatcagcttgccatcacggataaaaaatacctgcaccaccgcgtcgcggtcatccgccgccagcgcaataatgtccttgtcctcgccgtccgtgtgcgtaatcttctgcttctgtgcgatctgtctgacactgtttaaaagctcccggtactcaatcgccttttcaaattccagattggccgacgccgtattcatcttctcttccagagactttagcaccggcgcataattgccatttaaaaattccaccaccgcatccacgcgctcacggtacgcttcctttgtgatatatccctggcagggcgccgtgcactgatgaatgtgataattcagacacgggcggtcctttcccgtgtcgcgcggcaggttccggttgcaggtgcgcagctgatagatcttgttcaccagctcgatcgtatccttgactgctcccgcgctcgtgtaaggaccaaagtaccgcgatttgtcttttttctgctggcgggaaaagagaactctcggaaaatcttccccgagagtcactctgatgtacggatatgtcttatcgtcccgcagcatggtgttgtacttcggccgatgttctttgatcagattacattccagtaccagcgcctccagttcggaatccgtcacaatgtactcaaaccgcgcaatctgttttaccatctgcgcttttttgataccctcatcatggcttggctgaaaatactggtgcacccgcttgcgcagactgaccgccttgccaatgtagataatggcatcacggctgtcatgcataatataaactcccggctgatccgggagttttttaagttcttcttcaattacaaacattactgttcctcatgatcctgcgtattgcgcagcaatacatcatccatgttctgactctctgcggcagtttttccctcctcgagttcctgacgggcttcctccgcctgctcgaagaacgtcttcttctctgcctcgtcctccggctccgggattcctttcagttcacggaaaatcttcatgaattccttaccggtaatcgtctcatgctcgtagaggtattctgcgatatgatcgagcacctcccggttctccgtgaggagacgtatcgcctcatcatatgcgtgattgataatggcaagtacctccttatcaatctgcgccgccgtgtcctcaccgcagatcagtcctgcgcggttgtccagatactggttctccaccgtcgccaggcacatcataccgaacttatcggacataccgtactgcgttaccattgccctggcaatcgccgtcgcctgctcaatatcgttcgccgcaccgctggttgccgactggaataccagcacctccgctgcacgtcctgccatgtaagtggtaatcttcgctaaaagttcatccttggtctggagatacttctcctcctccggcgtctgcagcgtgtagccgagcgctcccatcgtacgcggaacaatcgtgatcttctgtaccggctcggtgttcttctgaagcgccgtcaccatcgcgtgtccgacctcatggtaggacacgatcttgcgctccttgtcactcatcacgcggtccttcttctccttgccgccgactgccacaagttcaaacgcgtcaaacagatcggactggttgacaaactttctgccgttcttgacggcattgattgctgcctcattgatcatattggcaagatcggaacccaccagacctgccgtcgcaagtgccagtgcatccagatccacggtctcatccatcatgacgtccttggaatgtaccttgagtgtctccagacgtcccttcagatccggcttgtcgacaatgatccggcggtcaaaacgtcccggacggagcaacgccttgtccagtacctccggacggttggttgcagcgagaatcagaattcccttggacgtgtcaaagccgtccatctccgcaaggagctggttcaatgtctgctctctctcgtcgttgccgccgtaacgggtgtcacggctcttaccgatcgcatcgatctcatcgataaagatgatacacggtgcctgcttctgtgcttccttaaacagatccctcacacgggaagctccgacaccgacgaacatctccacaaaatccgaacctgccagcgagaaaaacggtaccttcgcctcgcccgccactgccttggcaaggagcgtcttaccggttcccggaggtcccacaagaagtgcacccttcggcagcttcgcaccgatgtcgcggtactttttcgggttgtgcaggaaatcgacaacctcctgcagcgattccttcgcctcatcctgtcccgcaacatccttgaacgtcacgccggtctgcttctccacataaaccttggcgttgctcttgccgacgcccatagcgccgccgcccatccggcgcatcaccacgccgagcacaacccagatcagcaccagcggaatcaggtagcttaaaatactgtaaatccaggtggatgtgttatccggaatcactccgctgatatccacgcccttttccttaagtaacggaatcagctcatcatccgccacacgcccgcagtagtaagtcacctcgtaaggtgttttctcatcggaattcagtgtgatgtcgatctggtacgaaccgatctccactgacttcacgcttctgccttcccatttgccagtgccgttcaccatgtcgagaaactccgagtaagacacctcctgcgtgctcatctggttgaactgattggttacaagactcataataaacagcgcaatcagtgaaatcagtataaatgccatcaaaatctgaccattgtgattccctttgccgccgtctccgttattccctccgtttgaattaccgttattgtaattgttattcgatccctgattgtccattgaagtatttatcctttccaacaggctccgccagttcagagtctggattcttatcgtatatcttctatattatattgaaaatggaatttaaaagcaatacgttcttcgtgaagttttcctgtcatttctaaaataattctaaaatttcccggcatactattttctgtgtttttgaaattgtgctggattttccggacacttagttgtatactgtatgggttatatagatcgtattactattattcacacaactgtacttttatatgaggaggaaaaccctatgcctgtaaaatatgtctttgtcaccggtggtgtcgtttccggccttgggaaaggtatcacggctgcttctctgggaagacttttaaaagcccgtggctacaaagtgaccatgcagaaattcgacccgtacatcaacatcgatcccggaaccatgaacccgatccagcacggcgaggtatttgtgaccgatgacggtgcagaaacagacctggacttaggacattatgagcgtttcatcgacgagagcctgaccaagaattccaacgttacaaccggtaaggtatactggtctgttcttcagaaggagcgccgcggcgatttcggcggaggtaccgtacaggtcatccctcacatcacaaacgagatcaagagccgcttttaccggaactttacttccgaggagacacacattgccatcattgaagtcggcggtaccgtcggcgacatcgagagccagccgttcctcgaggcaatccgtcagttccagcacgaagtagggcacgagaatgccatcctcattcatgtaacattgattccatatatcaaggcatccggcgagcttaagacaaagccgacacaggcgagcgtcaaagagctgcagggaatgggtatccagccggatatcatcgtctgccgttccgagcatccgctcgatcagagtctcaaggacaagatcgcgctgttctgtaacgtgccgaaccgcaatgtacttcagaatcttgacgttgaatatctctatgaggcgccgcttgccatggagaaggagaatctcgccaaggttgcctgcgaagcgcttcatctggactgtccggaaccggatttaaaggactgggaggcaatggtcgacgcactccgtcatccgaacaaggaagtgactgtcgcattagttggaaaatataccgcacttcacgacgcttatatctccgttgtggaggcgttgaagcacggcggcattgcggagcgcgcaaccgtgaatatcaagtgggtggattctgaggacgtcacaacagagaacgtggacgagatcttatccgatgtatccggtattctcgtaccgggtggattcggttcccgcggtgtcgagggaatgatccttgccgcaaaatacgcacgtgagcatcagattccgtaccttggtctgtgcctcggcatgcaggttgcgatcatcgagtacgcaagacatgtctgcggcttcaacgatgcgcacagcatcgagcttgatccaaacaccacgcatccggtcatcgcactcatgccggatcagaacggcatcgaggacatcggcggaaccttacgtcttggttcttatccgtgtattctggacaagacctccaaggcatacgaggtatacggtgctgaggagatccatgagagacacagacaccgttatgaggtcaacaacgacttccgcgcttctctcaccgagagcggcatgaagctctgcggtacctctccggacggcagaatcgtagagatgattgagattccggagcatccgtggttcgttgccacacaggctcatccggagttaaagtccagaccgaaccgtccgcatccgctctttaaaggctttgtggaagcttcgattcggtgcagcgagaaataagatagataaaaaaggaagggagcgcagctttaaagttgcgcccttccctttttacatctggtgtcttaccaccgcatattcatcgtccagctgataatacggacattctctgtaatgtccctgcatcagtctcgccgcatcatcctcatccatatccacttcacagtagtaggtctcgtcatcttcatcgtacacattgtatacacagctgtcacagcttgccttcgccataagacgtcctccttttcgcatttctgttctatttccatgttgaaatcacttcatcgtacagccgcaacagaaaatcgtgcagcaattccctctgtgtatcccagtagacctccgtgatctcatcaccgtcctcctgcgcttccgtcacatccatcaccgcatccagaatctccgggttcagatcatccatcgcctcctgcacggcagcctcaaaatcacaatagctgtcactggtcagatataggataaaattctcccggttcaggtttctcgcctcatagcttcccgtaaacagatcgttcccgatcgatgcgatccgctcaaactcttccttgaccgtctcatattcgacggtgcagtaactctctttaaaaaatttatcaaatacttccttgtctatcttctgtcccattcgtttcacctcttgcaatttctcgtgtgccgtgctattttaacataaaattaagaaaagaggaacccataccatgaatacacttcccaaagatcccgtcatgctcttaagctttgtcaacacacagcttcgtgaccactacccgtcgctggaagaatttgccgcaacctaccagattgatgctacagaggttatctctgcattaaaaaatatagactacgagtacgatccggcgaccaatcagtttatctgatccgtcagccccgcttcttccggcacgctaatccacagtctcgtcacttagatattttcgcacgcgcttccagtccgggtaaaacttcgtcatgaatccccagaagcgctgattgtggctcgcctccagaatatgtgtcatctcatgtaccacgacatactcgaggcactccggaggcttggacaagagcgccagattgatgttgatgtgatgtgtctgcacattgcaggacccccatctcgtcttcatctgccggatggtgattccggagactttcaccctcatcaccggctcccattttgccacaagacgctccacctcacgctttaactgtttctttctgcgcgcgatttctgccgcatccagctcccgtttttccgaacggcgctctccggcttctttgtatttctgctgatatttccgtatccattcgatccgttctctggcaaatgccgcaatccgcgcatcactcatctgatgcggcgctgagatccgcactgtaccgtcctctttactgatgcgcagatacatgtttttcatccgttttttcgtgacaatgatcggcacgccctctatctttatctcataagtgcgctctctcatagttcctgctccccgtatgttttcaaaatagtttccagatactcgcggtattcccgcacaacagattccggcgactcgatccgcactgccgcgccaagtccagccagccagccgaaaaactggcggctgaccgcgacactcacccgcacccggattcttgtctcatcataccggcgcatcgcgacctccttgccgaaacggtcgatcatgactcccgtgagggcgtcttcgcagattaaggtcacagtctcgtcctcccccgcgaacatgccgaacgtttttcgggaatatgccgccacgtcaaagctcccgaactgctccttcccctctctgctttccgccgtaagttcgatctttagcattttatccacacggtaatggcggatgtcgcggcttctgtcgtcgtaggcgatcagataatagttttcgtcatcccacgagagcagccagggactcacttcatagtaactgccgtcccgccgcagtttcatctctttattgaccgtccattcaaaatactgaaaacggatcttcacattttccgcgatggcattgtaaatcatatctacattataataaatgttttcattgaccgccttgctgcggttggtcaccacgacctgcctgtggagctgctttgcctgttccctgccgcaaagcgtctccagcttggcaatcagctctctcgacttcttcgtcgtgatgaacttcgacgcctgcacggcatccacgagaagttttaactccgccagttcaaatttgcggctggcaagataatatccgccgggtcgctccttcacccgtataatatccagcccgaaatcttccagttcctccatatcggtgtacactgtcttgcgctccgaacggattccgttcgcctccagatagtcgatcacctcctgcgtcgtcacaggatgatcctcgtccgttctctcatataaaagctgcgccatgtaaagcagcttctgtttctgcttctcgcttcttcctcttcccatgacatgttgtcctttccacgcaggtgtccggcatttcttcgcagtgccgcgtgatgacaggcattcgcactatcagccactcgtatattcttcgcactgcatatcacgctccggatcgagtaggaggaatttctcttaaataagaaattccgacctctcacaccaccgtgcgtaccgttcggtacacggcggttcaatcaacttaacaagttgtacacctttcggtgtagtaatctaacattgagactaatccgaatgaggttagtctctttatgcttatagccttttgtatccatccattatgacacatgtgtgcataacgatttcctgtatttgccactttatgtgccgcccatcttggaacaccgagcttaactaaattcttctctttgttttgtggtgttttccaatgtttccaaatacacatgcgtagtctatatctaatgtttccatcaagttctctacagagagttttcatactacctatcttaaagtagtttatccatcctctgataagctgattaagtttccccactttatagctgttgctaacgccccagctacggcaagtgagttccctcattctcttcttaaacttggctactgattttgcatgtggttttgccttgaattgctgtgcacttgtatcgtagtagaatccaaacccaaggcattttaacccttgcggtctatctactttgcttttagtcatgttgaccttaagtcctagtttctcctctatgaatcgtgagatatttctcataactctattcgcagacatttcacttccgaccatgataatacagtcatccgcatatcgcacaaagttgagtcctcgcttctccatttccttatctagttcattcagcataatattcgccaatagtggcgagagatttccgccttgtggtgttcccacaatagaatcctcatattcgtcgtcaatcatgattccactgacaagatattttctaataatagagataacatctccatctttaattgttcttccaataatcgtcatcagtttgtcatgatttactgtgtcaaagaacttttccaagtcaatgtctacaatccagtcattaccatcattcattatatcgagtgctgtcaggattgcctgctgtgcacatctattcggtctgaatccgtaactatggtcatgaaactgctcctcatagattggtgttaatatctgcgcaatggcttgttgtataaatctgtctgttactgttggtactcccaggtttctgacaccgccaccaggctttggtatctccactcttcgtactggctgaggtttatattttcttgtcctcaactgttccttgatgatttcgccgttctttgtaagatgttctttaagttctgtgtacttcattccgtccactccctcggcacctttatttcgtacgacttgcagatatgctctgttgaggttatcgctggatagtatctgctccattagactacttgtctccatgcgttcttttccttccgtctcgcttgatttgaccatcttttgcccgattagttacggcagatgttatctcttctgcaattcaagacatactcaaacttgttgattgttcgccccttcgctccatctccattacagagacttcctcactactatgggctcggctgacttctcacagtttgttgttactaggctaatgaaacctctgtgagacctccacgcttaaggtgcacgctctttcctctcacctatccgccacatctactcgtacttccagcaacttttggacttcatctcttttggcagacttatccctatttccgagccttatatgtgatttctgtccgtcggaccaagagtttgcttacagcttccttcagattccacctcacgatagacacccttgctgttcggctatacacttcctcgttgcctaggcgtgttcgggactttcacccgttagagcgcgcccatggcgcgcaaaccaaaagccgggaaaacctccggtttccccggctcgctggcgcgttcatatggagcaaattcgtccacctcggtttcgcagtgccgcgtgaaaacgcttcgcttttttcacgctgacgtgcattcgcactatcagccactcgcagcggcgcgttctctgtgccagcacagaacgcgccacttctcctgtctgcactgctcattgcttattcacattataccctaattcgtgatgatatggggcactttcttgcaaagccaggtgcaatgtctgttttttcaatcaggtcttgcatcctgttcatttcgtgttataatatagttaagttcataagaattaccgagagacatgagcaaggtaagagcagagacgatgagatcgtttttgtttgccttgctctttttgtatttcaaagaaaaggagaatgtattatgtatgatgtagcaattatcggtgccggagtcatcggcagtgcaatcgcaagagaattatccagataccaggcgaacgtctgtgtcatcgagcgcgaagaggatgtctgtgacggcacctccaaagccaacagtgccatcatccacgcaggcttcgacgcagccccgggttccttaaaggcaaagttaaatgtccgcggcaacgagatgatggatgccctctcaaaagacctcgacattccgtttaagagaaacggttccctcgtcgtatgtaccaaagatcaggaccgcagcggtcttgatgcccttttagaaaagggtgagaaaaacggagtacctggtcttcgcatcttagagcgcgaagagctgcttcagatggagccgaatttaagcgacgacgtgacctgcggtctgtatgccccgaccggcggcatcgtctgcccgttccacatgaccatggcatttgcggaaaacgcatacaccaacggtgtttcctttttcttaaataccaaagtcacttccattcggaaaaaagacggcagttacacgttagagaccatccacaccgacacggatacaccggaaacctttgaggcgaaggtcatcatcaatgccgccggcgttcacgctgacgaatttaacaatatggtaagtgaacacaagcttcatattaccgcccgcaaaggcgaatactgcctgctcgacaaagaagccggaacgcatgtatcgcacacgattttccagcttccatccaaaatgggaaaaggcgtgcttgtcactcctaccgtacacggcaacctcttagtcggcccaaccgcagtggatgtcacgaataaggaagcagtcaacaccacacaggacggactggattccctcgcaaagactgctgctttgagcgtcaaaaatgttccgatgcgccaggttatcacctcatttgcaggtctgcgcgcacacgaagacggcaacgatttcatcattggggaagcggaagacgcgaaaggttttatcaacgcagccggcattgaatctccgggactctcctccgcaccggcaatcggagagatggtcgcaggtatcgccgctgatcttctttcccttacgaaaaaaacagattttatctccacaagaaaaggcatcttaagaccggagacactttccatggaggagcgcaatcagctgatcaaagagcatccggaatatggcaacatcatctgccgctgcgagatgatcagcgagggcgagatcatggacgccattcaccgtccgctcggtgcccgctccctcgacggagtaaaacgccgcacaagagccggcatggggcgctgtcaggcaggtttctgctccccgcgtaccatggagatcttagagcgagaagtaccaatgagtatgtttgatattaccaaaaacggcgtcggcggcaatatcgtcatcggcatcaacaaagagatttaaagggggattctactatgaaaaactatgatttagtcatcgtcggcggaggtcctgccggacttgcagccgctgtatccgcaagagaccacggcatcgagagcatcttaatcatcgagagagacaaagagctcggcggtatcttaaaccagtgcatccacaacggtttcggcttacataccttcaaggaggagctgaccggaccggaatacgcttcccgcttcatcgagcaggtggcagagcgcggcatcgagtacaaattaaataccatggtcatggacatcgctgccgatgccccgtccggaaacgtaatcacaaaaaaagtaaccgccatgaaccgcgaggacggcatgtttgagatccacacaaaagcggtcattctcgccatgggctgccgcgagcgttccagaggtgccttaaatattccgggctatcgtccggccggtattttttccgcaggtacggcacagcgtctggtcaacatggaaggctatatgccgggccgcgaagttgtcatcttaggttccggtgacattggtctgatcatggcacgccgcatgacgctggaaggcgcgaaggtcaaggtagttgccgaactgatgccttactccggcggtctgaagcgaaacatcgtacagtgtctggatgatttcggcatcccgttgaagctcagccacaccgtcatcgacattgagggcaaaaaccgtgtcgaggctgtcacgattgcagaagtcggtccggaccgcaaaccgattccgggaaccgaggagcgctacacctgcgacaccctgcttctctcctgcggactgatccctgagaacgaactgagccgcagcgcaggcgttgccatcaatcctgtcacctccggtccaatcgtcaatgacagcttagagaccagcatcgacggcgtgttcgcctgtggaaatgtccttcatgtacatgaccttgtggactatgtttcccaggaagcaaccgcagccgggaaaaatgccgccgcttatatccaaaacggctccagcaaagatgccgcatccgtcgagattttcccggtggacggcgtgcgctacaccgttccgaaatatgtccgtccgaccgagatggacgacactttaaccgtccgcttccgtgtgggcgcggtatacaagaactgctcgattgcgacttactttgatgacaccttaatcagcaagcgcaaacgtccggttatggctcccggcgagatggagcaggtaattctcgacaagaaaaaacttgctgaattcccggatctgtccagaatcacaatccgcattgaagaaaattcataaatagaatggaggaatcatcatgagcacaagagaattgacctgtatcggctgcccgctcgggtgcgccatcacagttaccatggacggatctaccgtcaccgccgtcaccggcaatacctgtccgagaggcgatgcctacgccagaaaggaagttacgaatccgacccgtatcgtaacatcgacggtccgggtgaacggaggcatctacccaatggcaaacgtgaaaacagcctccgacattccgaaaggcaggattttcgactgtgtcaacgccttaaaggatatcaccgtcaatgcaccgcttaagatcggcgatgtggtcttatccgacgttgccggaactggtgtcgacatcattgccgccagaaatgttcctgcaaaataagcgctttcaaagaatctcactttattatataataaggtcatcatgcgatcggcatgatgaccttattgattcaccgaatacaggagattgtcatgaagaaattatttaaagaagccctggaggattctcccatcattgcagcggtcaaagacgacgaaggtctttccagatgcctgaccagcgacagccgcattatctttatcttatacggcgacatcgtcaccatcagtgacatcgtggagaccgtcaaatccgccggaaagcttgcgatcgtccatctggatctcatcaacggactgagttccaaagaagtggcagtcgactttcttcaaaaatacacgaatgccgacggcattatcacaacgaagccgacacttatcaaacgcgccaaggagctggggctctttacaatcctccggctgtttctgattgactccatggcatacgagaacatcgaccgccaggtcaaatcctcccgcccggatctgatcgaaatcctgccggcactgatgcccaaggtcatcgccaaagtctgtcagtccacctccacaccggtcattgccggcgggctggtctccgaaaaggaagacatcctcgctcttttggatgcaggcgcgaccagtatctcctccacaaacgagaaaatctggtttttataagcactcctctcctgcatgtattatgatgcagtgccagacattctgtgctggatcatatgcgccaccagcaggattacaaaaatgcaggctgcgtttattcttcatattcgattcccccgcttcctgttttttcttccggaagtgtctttacaaagcaaaaaaagtagatgacatgacatacccacacaacggataaaacaatccgtccgacgggcacatttttcatacagataaatccgatcgccataagaagcgtcacagtggcgacaatactgaccttggttttcatctgcataccttcttttctcacataggattccagattctttttgtaaagatcggtaccggtaaaccagtcatgaaggcgcgttgaactttgtgaaaagcaaaaaagcgtcaacagaaaaaatggaaccgtcggcagaatcggaagcacaataccgatacagcccagcgcaaggctgatacacccggcggctgcgaaaaaatattttttaatcttcaatctctgactcctttgttatgttttgttggttagtcgtgactaatctgcaaaatcataccataagttgttccgcagtgcaagccttttttcaaaatccattttcgcttttcagctgctttttgcgagctgtgcaaaaaaaagaaccactaccttacggcaatggttctttcaacaattcatgggcagaggtggattcgaaccaccgaagcaatttgcagcagatttacagtctgtcccctttggccactcgggaatctgcccatttgtcaatgtgtcctgacagaggtaaattatatcacagcctaagcagatatgcaagttataaatttaaaaagtgtcacctattttcaataaatgcccggaaaaccaaaggctttccgggcgttgccgttcattcaggaaatcagagttttctacacatcaggattccctataacataccatccttgatcacatcatgatcccggagcagcttctccacgacggttcccttgaccacacgaagcagcggcttcttcaatacattgagcggtcccggcagttcgatctcaagcggagactttccatccatcagcttcacactgctgtcgagcagctctctgacatcatagacacttccccatacctcaggaacgcctctgtctacaccgagcagtccgtataccgcctccattgcggttctgaccgaatattccgtcgtgaagaccgtatcacgcggtgtgtccgcgaactgtccgaggaacgcaaagttcacacagccatccgggatgacgtccgggcggtcgcccttggttctcggcataaagaacgctgtgatgtacggcatcatcgtcggtacacatacggcgctgttctctgccagatccgggatctcctccaccggaacacccagatgatacagccactcctcggtgatctccttaccggtacactccttcatcggcttcttcacataatcgcccggcacatcggtgaacagaccgtatacccacacgcatactttatccttatcctgatccttgaactgtccctggcggttgatcgtccagctgagcagccagctggaatccttacagcttacgatacctccggtcacaacttttccgcttctcggatcacgcttgcagatattcgtgatgtacggaatgatcttgtcgtccaacgtggtcacggttgcagattcccagttcgtcttcgctacatccgagcagaacttctccggatgtccaaaagacggatcctgctttgcaatattcttccacaggctccagcagccgctcgtgcgcacttccgcgtccccgttcggcgcatggttctgatcaccgtaaatcgtaccctcggtacagcttccgtttgtcacgaacacgagatcattctccgtaagcacaatacctttctccacaccgttgaccttgcactcgagcgccttggcaaccttcttgtcatctttgatgtcgaaaatgacattcgttacctcggtgttaaactggaagtcaacaccggcttcctcaaggtatctctgcatcggcagaatcagcgactcatactgattgtacttcgtgaacttcaaagcgctgaaatccggcagtcccgcgatgtgatggatgaaacgctggaaatagagcttcatctccagtgcactgtgccagttctcaaaagcaaacatcgtgcgccagtacagccagaacgtagaattgaatacctcgtcgtcgaacacatcctcgatcgtcttgtcgtagagatcctcatcctttgtcatgaacagcttcatgatctccatgcagcccttctggctcagattgaacttgccgtctgtgtgcgcatccttgccgcgctcctctgtggcacggcacagggaatagttcgggtcttccttgttcagccagtaatactcgtccagaacggagacgcccggcgtctcaatcgacggaatgctgcggaacaaatcccacaggcactcaaaatggttctccatctcacgaccgccgcgcatcacatagcctctggtcggatcattgataccgtcgcaggcgcctcccgcgatgtccatcgcctcaagaatgtgaatgtgggaaccttccatctgaccgtctcttaccaggaagcaggctgctgccagagaggccagtccgcttccgacaatataggcgctcttctcatccacaccctccggctttctcggtctcgcaaaagcctcgtaattaccgttggtatagtaaatacccttgctgttcttctcatgcttgccgcgctcggtattgcggtattccgctctcgccttctcctcgattgctttcttctgcgcacgctcgctgctgttcttatggctgcctgccgccagtgccgccacacccgctccggctgccagcgcagccacgccaagtcctatatgttttccttttcccatcgtaactaccacctttccacttatgctgtaaattctttgtgtccttatcttagtctgcccagatgaatgacacaatttacaaaaagatcaaaatgataaaaaacttatcattccgtctcttttgataagcttgcggattgcttctgttcaaaattccgggcggcatttaagatactgccgtgcagcatcgtactcagccgctgcacaagctctctgtaatccgccttcataccgccgtcgatccagtgcagcatcatacctacaaagccgtatttgtagaactccgcaatcagtgccttgtcctccccgctgacagccgcatcgcggcattcttcctctaccacatctgcgagcagatcataggtcagcttatagagatagctctcgatcttcttctggctgaccgagtgataaacattcaaaataaacggcttgttctccaataccgcctcaaagatctgctccagtccttcactccacgtactgtaagttttcttatccgcaagtgcacgctttccgtcctccaggcacgcccactcaatcaggtcgtaaatatccttgaagtgatagtaaaacgccatgcggctgatcccgcagtcctccgtcagatcgttgatcgtaatcttatccaccggcttcttaagcaaaagctttttaagtgatgcctccagtgcaagttttgtcgtgttggacatggctgcctccctgttccgttcttgcggcaacggatcttaccgtccgcacctttattgtattcctcctcgcaggtatgggcaaataaagaatttctaaattttcttaattcttttttagccgttaatgcacgtttttgaccacctgcacatccaaattactatatacatttatgatctatttgttataatattattatatttgcgcttatggacaaattgggtggttttcacacatatttgaatgcgcaggcggaggaatacatgatcagcaacacggatatccgttacttttttgatacttactatgacaacttcatgcacagtctcgcctgggaggatcaccttctggagcctgccagccgtgaggaatggctggcaacgcttcgcgcatgtgcagacgaccagcagcagcgctgtgcggacaatcagatactgcttgagcagtatctctatccgctaagcagcaatcctgctcttctgtccgatgagggatatgatcttttactttctttttgccgtgatttttactacagcaactataccgaaccggctctgctgatccgcattattgatatcctgcttccacattatgaagaccgcagcgatacggaaagcctgctttttctctacatctgcgccggcttttcatacatggagctctcacgaaccggagagcccacctctcgtgataagactatatatttctacaccaaagtgctctcttaccgcgatcagattgaattctttgaatcagctgcaagccgcgactatatttttattgcctattacaatctgatccgggtggcgccgggtcttggcatcttagacattgagaccgcttaccggctctgggaggagctctgtcagatccgtaccatgcccaaattctgtcagtacgataccaccaatccacggattccgcagctctgtgactgtgcaatcaacgatttccgcgcgtacggcgctgttcttaacgttgaacgtgttattgcaccatccgcgatcctgtcctctctggagaatatgacgcagatctattactccgagatattgcacgagcatggttccatctatgagtgccctgcattcacagtatttaattaccactatgtgcaggcacgcaatggtacaatcacctgggaagccgcctggcagatcctggacgattattatgtccacaagatgcagaccatcggtcaggtttcctcgcctgacctgcttgctttttataccaatctgccgctcaacctgatcgacgtgctggggcatacgcatttcaaggaagagtttaagcaggcaacttaccggcgctaccgcaatctgattaccagctatctgatgaatcagcctgccagtctcaattcctacacgttaaacaacggtgtccagctggtggcgtttcacccgctgatcctcgggactttccagaaccgtatggaaaaaatgaactttatcgtagatctggtcgtaaccagacatctcacgacattcacacactccgttatggtttcctatcttgcagaagcgatcggaaagcatattttagccgcacggccggagcttttgcggattccgtcctcctatctggagggaaatgtctatgcctcccccgcggaagtactggactatatcgttcccgcagctttattccacgatattgggaaaaacggcatgatcccgatcatcaacacgcagcaccgcaagttaaatgactacgaatttaacattattcagacacatccgcagaagggctccgactatctgtcgtccgatccggactttttaatctaccagccggttgcgctcggacatcaccgctcctacgacggtacccgcggttatccgctcagttttgacaataccgcctcgccgtaccgggacgccatcgacctgatccacatctgtgactgtctggatgcagcgaccgattacttaagccgcaattaccaccgcgcgaaaccgttcgatgtggtattgaacgaactgaaagcagggcgcggcaccgagtacaatcctgatatggtggatgtgattctaagcgaccgggaattatataacgatttaaagatgcttacggagcagaaccgtgaaaatatctactatgatatctatctcacgtttgtgaatctccgcaagaaaagacaataaatgggatacgttttattatgagaatatcagaaaatatgaagttccagaatgtaaccggggcggcaattctttgaagcaaaatccgaggatttcttccgtgctgcgtcgggcatcgggttctgtgtctttccaagtttggacagtccccgtggtgtgtccggcaaaaccgcagacaatgagcggactttctggtgcccctagtggcaccgcttcacagacaatataaaaccgcgcgaaccgaactcgttatcatctgctattgaaaacagggcagatgacaactcagacagcggcttcgcgcggttatgttctgtttgctggtgccacgaaggggcacgcacaaaagtccttaaattgtctgtggtttgcggacacaccacgaggaatgttccaaacttggaaaaacacagatgatcagggatgtccgacgcggcatggttagaaatactggattttgcgattagaattgccgcccccggttgcatctggaacgtgatagtctctgtttcttataataaaacatatcccatttcaaatatttttattagaaggtaaaaaaaagacagcctgtcgaactgctgtctttttaggagaaggtatttttactatggggtatagcaaaaactatatataatgtattggggggtttttacggttattataatagcatgccccgccagataagtgtgcacaaacttcacaattttgtgtgcacgtttttattcattttgtatagtaccttctgcccggtttttcttttttcattgccgttatgcacaattactgctcaaacaattcctcaaactcctgctggctgattttttccttctccagcagaagattcgcgcaggcatccagcacgtcgcggtgctccgcaatcatctgcttcgctttttcataacattcgtcaatgatccgcttcacttccaggtcaatggtggtcgcaacgccctctccatagcctctcgtgtgcgccaggtctctgccgataaatacctcatcgtcgtcattgtcgtagcagatcagaccaatgttctctgacattccgtattttgtgaccatatcctttgccatccgggtcgcctgcttgatgtcctgagatgcccctgtcgtgatgtcatcaaatacaagttcctccgccacacgtcctcccagagatacgataatatcctgcagcatcttgcctttcgtgttgaacatgtcgtcacgctccggcagcggcatcgtgtaaccggcagctcccgctcccgtcggaatgatcgatacggaatagaccggaccgacatccggaagcagatggaacagaatcgcatgaccggattcgtggaatgcggtgatacgcttttccttctcggagatcacgcggctctttttctccgcgccgattcccaccttcacaaacgccttcttgatgtccgcctgtgtaatatacgcacggtcttccttcgctgcgataatagccgcctcattcagaagattctcaagatccgcgccggtaaagcccgcagtcgtctgtgcgatctgttttaagtcgacatcatccccgagcggcttgttcttcgcatgaacggaaagaatctcctctcttccgccgacatccggacgtcccacatgcaccttccggtcgaaacgtcccggacgcatgatcgccgggtccaaaatatccacacggttcgtcgccgccataacgataattccctcattgacaccgaaaccgtccatctcaacgagcatctggttcaatgtctgctcgcgctcatcgtgaccgccgcccataccggtaccacgccgtcttgcgacagcatcgatctcatcgataaacacgatacacggcgcatttttcttggcttcctcaaacagatcacggacacgcgaagcgccgacgccaacaaacatctccacaaaatccgaaccggaaatactaaagaacggcacgcctgcctcaccggcaatcgcctttgccagaagtgtcttaccggttcccggaggtcccacgagaagaacaccctttggaatacgcgcgccaagcttggtatacttcttcggggcacgcaggaaatccacgatctcctcaagctcttccttttcctctttcagacctgccacattggcaaatgtcacccgctttgccgggtcatctgtcatgagctttgcgcggctcttgccgaagttcatcatcttaccgccgccgccggaattggcagccgcctgattggtcataatcatgaagaaaatgaacatcgccgcaaaaataatcagatacggaagtatcgtcacgatccagctctgctccggcggattctccacggtgtaagacgtaaactgctgatcgcgcagataatcttctatatcatttacatcgtttaccgccagaacctgtgtcgaggagtccttaaatgtaatgtatacattaccggtcggcacctcgccgcggttcggtacaatcttcagctgtgcaacatttccatctgcaaccgcagtctcaaactgtgcccgcgtgtaactgttggttgacgtgtttccgtccatccaataccagatacctatgatggcaagtatcaggagcagatagatgccaaatcctctgtaactgcttctcttactattcaatcgatttctcctttattcctctatctcaacaaatccgatatacggcagattgcggtacttctggtcatagtcgagaccgtatcctaccacaaattcatccggaatgacaaatcccacataatccacattgacatccaccactctccggtccggcttatccagaagcgtacacagtctgagtgtcttcggatttcttgtcttcaaattctccaacaaatagcttaaagttctgccggaatcgatgatgtcctcaattaccagcacattcttgccttcaatactggttccaagatcatttacgatacgcaccacgccgctggaacttgtgcctgatccatagctggataccgacataaactctatctcaaccggtgaagtaatacgctttgccagttcgcaggtaaaaaataccgatcccttcaaaatacagatcagacataccggctcatctccgtacaccttgctgatctcggctcccaactctcttactctctgctcaatctgttcctctgtgagatgaacgttaattttcttgatcttcacaatcgtttcctccacttaaccgtacttctaatatcttttctgtattctctccgactttgcagccggcgccgatgcgcccgcctgccacccacaggatctcggatcccgttgccagaagccatatagcgtctctcttcgccgccggaatcttctcattgacaaaatattccttcagcttcttggtatgtccggcagcatctatcatcaggtaatcgccgctctctcttctgcgcagccgcagaccagattttattttaccataatcaaaccatttcgtatatgtttttttcgggatttcctgcatattccccgaaaaatcacgtatccgcaggtgcagtctgccatccggcagcgcaagcaccacctcttccttttctgcgcgcgaaagcatctccccggtaacctcaatgctctcccgttccatatcaaccgccggctcttccctgtacagccggattccctcatacacacgctccgcacgcacgccgtagggcaggcagatcacacggccgacctgtcttgtatacagtgtgcacagttcttctacatgcacacttccgatgtcacggttgctgcccgccactttttgcagcgtcacaagcagtacttcccggattaaaagtgcgggatattctgaaaaaagaaccgcatcgatcacacaggcatccggggtgtcacggcacacacgctccgtcgcccggcgcgtctcttcctccaggtaatccgacaattccattaacatctgtgcgctctgcatcatatgatgcaccgcccccgtattcaccgcttttaattccggcatcaccttatggcgaatccggtttctgctgtagtcggtatcctcattggtcgcatcccggcagtaaggctgtccctgtgccttaagatacgcctcgatctccgctctctccattccaagcagcggacggatcaccgtgacaccctccgcgagcctgcgcgccgggcgcataccgtagagtccgtggattccgctcccccggatcagccggaacagcatggtctccgcattatcatccgcatgatgcgcgagcgcgatcttcaccggtctgccgtcatagtcctctgctgcctccctgaagcactcatagcggagcttcctcgccgcctcctcaacgccgaggccgtgtcccttggcatacgccgggacatccaccggataaatcctgcagcaaacgccccgcttttcgcaaagccttttaacaaacgcggcgtctctcctgctggcctctccccggatcccgtgttccacgtgcaccgcctccaggagaaaatcgcagtgcttccggtactcaagcagcataagcagcagacataccgagtccgctcctccggagacgcccgcaagcaccacatccccggatttaacaagcccctccagttccattcctttcttctgcatcgcatttcctctatcgtttcacattctattctatgcctttttccagatgcacgccgcaagtaccgtcatatcgtcctgtgcgcgcccgccggtaaaaagcatcactctgtccataatcttttttgccagaattcccggattgttggttttgatactgagaatcatttcccgcatcgtctcctccggcttcggaacatgtaagtattctaacacaccatccgtcaccatgacaataaaatcaccgtcgttcagctgtatctccctcggttttgcatccaggtgcgcacgcgcccccaccggcagattttccgatgcaatgcactccacctcatcctcccgccggataaatgcagccgccgctcccaccttgtacaggcgtgccataccgctgtacaggttcaccatgcagaggtctaacgtggagtagatgtcattttcccctttcatcaccatcgccgaattcatcatgcgtattgccgtctccagggaaaaccctgcttccagaaaacgttccacaagatccagcaccatctcgctctccttgcaggcactgctcccggagcccatgccgtccgacagtccaagcagcatttcccctcgctcgagttccagaaaagaaaagttgtcgcctgaaatttttgcctcatccttcttcacccgcgcaattccctgcacgctccggtatgcggtgtcctcgtagatcaggaaccggaacggctcctttgcaataaacgtccgcgcatccgcggttgtccggagcttttttccaagcacggcgccggagagcgtcagaaatgtcttcaccgcgacacagcctcccagccggctttttagcactgcgtcaatccggatccttccgtccaccgcctcgatcaggtgcagttcttccaccacaatcccctgctccttcgcacggtattgaatctccgagaggacatggcgttcccccacgtccagaattttttcctccctggcgcagtcctgcatgatatacgccatcgcatccagctgttccgctatcacctcccggttctccaccagtctctggtaccatgcccggtttaagctgacgcgctcaaagacgcgcaccgcctcctccaccatatcgctgctgtgcctgcaatactgtacaagctcctgctttttctcctccccgggagtctctccgttccagatcgcggaaaggatccccgacagcgcgccgtataagggtgcaggatctctctcccagcagactgcacacgcgtcacacgacgcgcagatctttccagtcagctcgttctgtatctgtcccagttcctccgccgcaccgttctgatgtgcggcactcatactgtgaaaaacctgggacaagccctgaaacgattccgcataccccagcagccgctcctctcttcctccatccggccgctccggcacccccgcctttcttccccagtgtaatatcatatgcagggcacggttaaaaagaatcacggctcccaatataaacgcgccctccagcgccgccgccagaattccgggctgatccttccattcaagaagtccccccgccaccgacaggatcatggtaataatcgctgccatactgcccgccatataggaggggcatccctcgttggcccattccacgagccggattgctcccatcaccacgacaagcgccaccgcatactttactgctgccgccgtcggcataaacacaaacattcctatgtacatcataccgagcagcaccggcccgctgacccgctccagatacagcgccgcaaaatacgccggcaccagagggtaacaccccatcacgcccacactgcacattacacttcccgccatacagagcatcatttgtcttgcattcatttttttcatcgcctacctccattcccgcctccggtctgtcccggtgtttttcgcgggtgacatcgattatagggttgttcccggaaaatctttgtcaaaggaaggaccccttttgaaaaacttttcgccaaaatatcggttccattgtctgtttcatggactttgaagcgcttcgtgccttttaggaagttcatccagaaatattcctctaccacattttttcatgccggtgttataatgtacgcaaaagcatagccaccatgatatgaaaggagattttcttatgggttatatggcaaaagaaagccgctatgataccatgcagtacaatcgctgcggcgccagcggtttaaagcttccaatggtttctctcggtttctggcacaattttggggacaccggacattatgacaacatgaaggcaatgtgccgcaccgcttttgataacggtatcacgcattttgatcttgcgaacaattacggtcccgcttacggcagcgcagagcgcaacctgggacaaatcctgcgggacgacttttctgcgtaccgggacgagcttctaatcagcaccaaagccggctacgatatgtggccgggaccttacggcaactggggcagccgcaagtacctcatcgcaagcctggacgccagcttaaagcgcctggggctggattatgtggatattttttatcatcaccgcatggatcctgagacaccgctcgaagagacgatgggcgctctcgattccattgtcaaaagcggaaaggcactctatgtcggtctgtccaactatgacggtccgacactggaacgtgcatgtgcgattctaaacgacttgaagtgcccgtttatcatcaaccagaaccgctactccatctttgaccgcacgatcgagaaaaacggtttgaaagatactgccagaaggctgcaaagaggcattatcgccttttcaccgctggcacagggcatgctcaccgaccgctatttaaacggtattccggctgacagccgcatcgcgaccgacggacgtttcctcaaggagaccgcacttacgccggagcgtctctcacagatccgcgctctcaatgagcttgccaaaaagcgtggacagacgctcgcggagatggcattaagctggatcttaaaggacggtgacgtgaccagcgtgctgattggtgcttcccgcccggaacagattctcgacaatatcgccattgtcggacatacttcctttacgccagaagaactcgacgcgatcgatcagattacactttaacagccaaaaaagaagccttatccgggatgatctctccgggtaaggctccttttattctgtcattcttatgttcttaaggttcttccttaaatataatctcattgtcataggctagtcccagtttgctcttcgcaatatcctccacatactcctgggactgtgtataggactggtaattctgaagttcctcctgccttgccgtctcatcctgaagctgcacctccagctgttcctgctttctggcgtactcctgatctttctgataagcttttacaatctggacagacattgccgctgcaaatacaaccagaatcatgctgatacagatcttgcccgccctgttattccgatttgattttctcttctttgctgccattcctgtccctcatttcctgcatctgtgtagcaatttacagtttacataaacctattttaaccgctctcacaaactttttcaatcgttttccacaaaatgccccaactttttttaaggttttccacaccggacgcacgaaaaatcccagcacttttccaataattcccagtatttttttccagatccacacctgacagtgcacgatcaggcggctgagcagcagataataacacgccattccgaccagcagaccgccaaacgcaaacccgcgcaccatgccgtcattttcccggtataaaaggacaaagaccacgcctgtaaaaatgatccagtacagaaaatcctccacgccgatccagatatttccgtgcggaagaatccggcggaaaatgcgcaggatatcatagagaaagaaaagtcccattcctaccagcacagagctcccgagaaacagcagttcctgatagattgatgtgcttaccgccatctaccggaacagccttcccagaagagattccgcctgttttcccgccgttttgacatccgaataggtcagggaatcaatccgtccctcaatatccacttcccctttttccaggctcagtcggttcacgtgcagatcctgtcccttgatgagcagcatccccagttccgtctcgagcagaatctccgccacatcaaaagacagcacatccacaacaccggaaaacgcgccgtttccccggtttaccagcaggaccttatgtgattttgccgtattattataattcttttcctccataaaaaaacctcccgctttccttttctattagaaagtatatgggaggtttttcatattatgatacatattcaaacaaatccttggcttcttcctttttcgtcgtatcctgcagatccagcacgcgaactttcacggtcttcgttccaaaaccgatctcaataatgtcgccgacttttacattcacggaagccttcgccggtttgccgttgaccatcacacggccggcgtcacaagcttcattcgccactgtgcgtctcttgatcagccgggacacttttaaaaatttatccagtctcatcttcttctccttatgcctgcggagcgttcctgcttccaaaggctccttttccttgaaagcaaaaaagtggattctgcaaccgcaaaatccactctgctatctctatatcacttaggcgttgatcatatcctttaaagccttaccagccttgaacttcggagccttggaagctgcgattgtcatctctttaccagtctgcggatttcttcctgttctctctgctctctcagatacctcaaatgtaccgaatcctactaactggatcttctcacccttctttaattcctcagcaacaacatctgtaaatgcctttaatgctgcctctgcgtccttcttgcttaactcagtcttctcagccattgctgcaactaactctgctttgttcatgttaaaaattcctcctctggattttcaatataaataatattcgaggttctcaaaatacctacttcatatttatacttgttttttctttctttgtcaagaaaaatccccaaaatatggggattttccgagcttttttacgtttgggaagcgtttacatcatggtgtcgatcaatgcgtgaaccgcttttgagagcgcttctgattttgcgtccgcatccgcgagcgatgtcccctttacgccgagataaaatttgactttcggttcggttccggacggtctgacgcacacccatgccccgtcggtcatctcgtaataaagaacattcgacttcggcagacctgtcggccgcactgcacccgctgccgtatccgtgatggtgtccagcttataatcccgcaccgccgtcactttgtatccaccgatctctgccggagcattttcacggagcgtattcataatctcctggatcttcgccagtccttcgattccctttaatgtgatggaagtcacatcatccttgtagtagccataacgctcatacatggcaagcattgcatcccagagtgtcatgttcttcgtcttatagtaagccgccgcctcgcacagcatcatcgatgctgcaacggcatccttatctctcgcgtaagttcccggcaggcagccatagctctcctccataccaaagaggtatgtgccctttcctgtctcctcaaactctaaaatcttctgtccgataaacttaaatccggtcagcacctcgatcagatctatttcgtagtatgccgcaatcgcatctgccatattcgtggatacgatcgaacggataaatgcgccgtcctccggcagtccgaagagctccttgcgctgtccgatcacatagtcgccaatcaggcatccggacatatttccggtcaggctgtggtattctccggtctgtgcatccttcacataaacacccagacgatccgcgtccggatctgtcgcaagaatcaggtcggcatctacttttttgcccagtgcaagtcctaatgcaaatgcctctgccgcctccggattcggatagcttaccgtcgggaaatcgccgtccggcagttcctgctccggcacaacgtagacattcgtgaatccaagctctttgagcacacggcgtaccggaaggttgccggttccgtgaagcggtgtgtatacaatctttaactcggatgcaactttgtcaatgcagtcctgatgaagcaccagttttttcagttccgcaatatacggatcgtcaatatccgcaccgatcgtctgatacagaccgtctgcctttgcctcttcaagcggcatcgtcttcacagaagcataatccgtcacgtttctcacttcatccataatccctgtgtcatgcggaggtgtgatctgcgcgccgtcctcccagtatactttgtatccattgtattccggcggattatggcttgccgtgatgttgatgcccgccgtacagccaagcttgcgcaccgcataggaaagctccggcgtcggtcttaacgattcaaatacatatgccttaatgccgttcgctgcaagacaaagcgccgcctcgtcggcgaactccggggacatatgtctggaatcatacgcgatggcaacaccttttgcctgtgctcccactttgcagatataattcgccagtccctgtgtcgctttgcgcaccgtgtagatattcatgcggttggttcccgctccgatcacgccgcgcagtccggcagtaccgaactccagatccatgtaaaagcgctcttcaatctccttctcattcccagcgatcgcctgaagctccgctctggtcgcctcgtcaaaatacggattgttcagccatgactcatatgtttctctatatcccatctcagattcctcctgctttttttctaagcctatcttatctttcctgttttgctttttcaagtaccattcctgtcataaattgatacaattctctcaattatttcccttaagcgcattgagcagggacgtaagggtggaaagataatccgaagtgctgctactgttggaactgctgctggagctgtctccattcttgtccagaatctcgtttacgatggcatccagcgcagcgtcactcgtcgtgtccgatgttcccgtcgatgtagaagacgaacttgaagatgaacccgaggaactgctgtccgagtgacttcctgccaggcttcccgcgagacttcccgcctgtccgtctgcgctctctcctgtggatgtactgctgtctgcctccgatgactgcgtctcacttccggtcgtagtcgacgagcttcccgattctcctgtcattccgatggcgatcgttgcctccggtgaattcacaaacagctttttgctgtatgtatcataaccgtccgccgtcacggtgagcgtatgcactccatactgtagttccaccggctggctgtaatccaccagctgcccgtctacctgaagccatgcgccctcaacattgactgcgaagagaatgcttccgtacttcggtccctcgccctttaacgtctcaagatccagaaccgtctcctgacctctcgtgatcgtaatctccgtacttccgccgtatccgttattcgcgacagctgccgtgtatgttccctcaggaatctcaatcgtcatctctccggtaatctgggcaaacaccttgcttcccacctgaatgtaacttccatcaaagacactggtattgaccagctttaacgaaccgtgcccggtggtcaccgagatggaatatattttcttgtcaattccgaccacccgaagcgtatccagtgccgtcagatctgaaagctggaggggacttccgtccgaaaccacaaacagatcctcatcatacgaataatttgtatccgcaatcttaaatgcaccgtgctcctcatctacactgtatctggtcacatccgggtattcccacgccagatcggagatctgcgcttccacaagcctgccctgcttatctttttccccgacacggataatgcgacccgcgtcaaatccagacaccggcatccggctgccatatttgtcaaggaaccgggtagcaatcgtgtaattatacatatactgcttgccggagttcaactgtgttaaaatcagacactccgcctgcatatcattgttagtgattaaaaacaggtctgctccgatcgacgtgccttcctgctccgtcccctgttccattgcatccagcacgtcgttcgcatccgcctccgtcccgacggtctgtgctgtgttttccgcatcctttgacggattatagtaagttcctgtcacaactgtattgctgctttttccgcatcctgccagtaacagcatcatgcagaccggcaggatccatcgaactattttcttcttcaagtatatctgctcctttatcgtgtacacaattctacggcaaaagtaccgccagattgattatatcctcttttttgcgctgctttctgcgcatccgaagttccaccggaacttctaatatgaatctgtcaagattcattatatcatattaaacaactcagcggaacttttatctcaggacgcgggcggctgcaaggtgaaatggcgcatcatttccaggaatcgttcccgctcatcctcctgccgtatgaatttttccagcttttcaatattgcgtccggacacccatgccttgtgtgtgttatagtagcggttcgcaattttccagaatttttccggatatgccatatacagatacagatagtttagttccacggcagtcagccggcgcacatggtcatacgcacagatgagatccatgccaagtccggtgttccagttgtttttttccagcattttccgcatgtagttcgccagatcgctgacctgtatctggtaggaaaagcactcaaaatggacaatgccgattccggttttggaaaacagaatattgtgctggttataatcgccgtgacaaaacccggcgctctgcccgccctgtcccatcgccgaaagttcctgtgccacctgccttgctttttccataaagcgctcatactgcccgtaaaagagcacttcaaaatcattctttttcttcttggaccgtatgtaattccggactttgaccagttcccggttatgcttctcatacagttcctgcagttcattcgggtcgttgcagacaaactccggaaccgtctccgaataagtttccgccgcattgtgcagcattgccagtttctccgcccccgcgatcatgtccgcccggtttctggtgtcacactcgctcccggaaacagccgtcaataccatatactttgtctcatcctccgcgacggcaatcggggcgtcctccttcgtccgcacgacctgctccgttaagagtccctgtccacccagatgcccgagtatggcagagagaaactctgcccgctccgccgagcctttgtattcttttaaaagtaactgcccctgtgttgtatcacaaatataactttcacgccctttggaaaccgctctcacttccaggtcgtactgctccaatacctgctccggtcgattatacacaaaaacccctccatatgattgatctgcggctgctctgccgtgtctcttcatcatatgtgaggggtttttatttcatgacctgttttgatcagaaatctttcctgtcacaatttttaataattgttccttcgtattcagcccgggatcttccagtacccgttccagcagttcattcagcatctccccgatctgctttcccggctgcattccggctgcaatcagatcctgaccggaaaccgccagttgccggatcgtaagacactcttttttctccatgcactcccgatacagctgttcatatgcgtccacatacgccagcttttccgcgcgccggtacccgctctgcgccagaatatccgcgcgcttgaccgcaaacaatgccggatactgttccacgccgatcctgtgcaccgccctgcggaccgccttcccggaaagctccggattatcatcgtgccagtgcaccagccggcacacccggtcggtggtatcgttgtcgaacttcagccggcgcagaattccacgcgccatctcgcttccgcgcaccggatgtccgtaaaaatgatccacaccttttttgtccgtcgtcctgcaggcaggctttgcaatgtcatgcagcagcatcgtaagccggagcaccttatccgccggcaccgcttcgatcgcctttagcgtatgttctcccacactgcagcagtgatgcggattgttctgcggcgtctccatcatcacgtcaaactccggcagaaaaacagccgtaagtcccatgcgatatgccactttcagctctcccggattcggcgaagtcaaaagctttaccagttcgacctgaatccgttccgcactgaccttttttatattgcccgccagtccggcaatggcttcctgtgtctcctgttcaatcgaaaaaccaagctgcgccgcaaaacggaccgcccggagcatgcgaagggcatcctccgaaaaccgctccatggcatttcccacacagcggatcacgcctctctccagatcgccgattccgtcaaaggcatccaccagtccggtcacttcattgtaggccatcgcattgatcgtaaaatcgcggcgtttcagatcctccagaagattcgcggtaaacgctacttcctttggatgcctcgcatcctcgtattctccgtcaatccggtaggttgtgacctcgaatccctcatgctccagcatgaccgtcaccgtcccatgctggatcccggtatcaatcgtgtgccggaaaagagccttgacctgctccggtctcgccgaggtcgtaatgtcccagtcctgcggcgttctcccgagcagggaatcgcgcacgcagcctccgaccgcatacgcttcatatccgtgctcgcctaaggtattcagaatcctcgcaaccttcgcaggcaggctgatctttgcatttttatccacgcacttctccttaatatgccttgccccagtataccagcttgtgcgccggtctgccgcagcatacgcaggttccggaaatctgctcctgatcatggaacgggatacagcgggatgtcacggcaagctcctctttgatcttgtcctcgcacgcctgatcctcgcaccacataccgcggataaatcccggtttgtttgccgcgatgtcctttaattcttcataattgtgggcatcccagatatgcgcgtcgcggtgtgcctttgcacgctcgaacatctctttctggatagtctctaaaatctccggaatcttctgctccagatcctccagtgcgacctcgatcttctctctggtatctctgcgcactaccacgcacttgcctgcctcgatgtccttcggtccaagttcgatacgaaccggaattccgcgcatctcctgctcggagaacttccagcccgggctcttgtccgagtcatccagcttcgcgcggcatacttttccaaggcgctcgcagacgctctttgcagcatccatgacgccgtctttgtactgctggatcggaatcaccatcgcctgtaccggtgcaattctcggcggcagaaccagacccgaatcatcgccgtgtaccatgatgatcgcaccgataagacgtgtggtcataccccaggaagtctgatgtacatactgaagcttattatctttatcggtatactggacaccgaacgcctttgcgaatccgtcgccgaagttatggctggtaccggactgcagtgcctttccgtcatgcatcagcgcctcaatcgtataggtagcctccgcgcccgcaaacttctccttctcggtcttgcgtccgcggatgaccggcattgccagtacctcctcgcagaagtccgcgtacagattcaacatctggatcgtgcgctgctcggcttcctctgcggtcgcatgcgcggtgtgtccctcctgccacaggaattccctggaacggaggaacggtctcgtctccttctcccagcgtactaccgagcaccactgattgtataccttcggaaggtcacggtaggagtgaataatatttttataaaaatcgcagaacagcgtctcagatgtaggtctgacacagagacgctccggcaacgggttcaatccgccgtaggttacccatgcaacctccggtgcaaatccctccacgtgatccttctctttttcgagcaggctctccggaataaaaagcggcatgtatacattctccacgccggtctctttgaatctgcggtcaagctctttctggatattctcccagatcgcatagcctgccggacggatgatcatacatccctttaccgcggaataatcgatcagctccgccttttttaccacgtccgtgtaccattgtgcgaaatcaacatccatcgatgtgatcgcttctactaatttcttgttgtcctttgccatcatctatctccttttcatagctcttactgccgttgcaagcagcttcaaggttgtctgtgtgcagctcctgcacaactaatgattttatgataaatggaaagggttgtcaatttcaaacgcaagatttctgcgtgttttcgggtgtctgaacccgattttgtacgaacagaggcagagcggttcccccgacggcttcatattctctttaaaattgtacttccggtctcccacaatcggcatccctgcatgtgccagctgcacgcggatctgatgatgtctgccggttcccagctgaatccgaagaacggcgcgcccgtttttctgctctaaaacctcgtaggaaagctctgccctctttgctcccggcgtactactttctacaaccgcagacgtattggttctgccgtcacgcagaagataatctgtaaactgcccctttccggcttccggcaccccgtctgtcacggcatagtaaaacttgtccgccagccccgacgcaatctgccggctgagtgcggccgccgactccttcgtctttgcgaacaccatcacgccgcataccggctgatccagccggtgcaccactccgatgtacggcggctcgcccttccccgcccgcctgtttttgagcaggctctccatatccgcctgtccgagccttttcgtctgtactgccacgcctgccggcttttcacagacaatgatctgctcatcttcaaataaaattctgatctccatattctaaaccgcatccaccatagtctgtgcccactggcgtgcatccgcaaaatctttctcatccggatgtgaaagcgcctcgtcaaaattttttacgctcgcattcaacttctgatcttctgggtgctcccgcagcatcgccacatagcggtttctcactccgatcggcattttcccctggcagtaaaagcttccgagcacctcactggtatccggaacgcactccgttacccggcacgccagcttctgatagtattctctggagccaccataaccggcagtgccgaaaaccgccagtttttttccttccagctgcttcaaatactcaccaaccgttccatcacagcttcccttgtccgtccaggatcctacaaaataaagatccgccacaatgtccggcttcggctcaccgaagtatacaatctcttcaccgccaagcgcatcccgtattgcttctgccacctgtctggtattccctgtcagacttttgtatatgattgcaatttttttcccactcatctgtgctctccttcgcccgctctgtcatcctactgcctatgatctctttaccggtctgccgtcgatacatccggtaaaatctgcttcgcgcgcagactcctcgcccggaagcggcgtatttctctgcccgccgctcttagagcactcttggcaggtgtccgaacccgcgtttgcttcctttctgccaaatcgacagacagtttcttccggtcccgacgaattatctgtcgaaccgccgctcgccagatatacgccctccgcatactcttttgtctccacaacttctggttttacatactttttcattttcctgcactccttccaaattataaattacagcttaaaccggtaccctactccccagattgttgctgcttcgcagcgcaggcgctcatttcagtacagcttcgctgtggagcgcctgccttgcacgcctttacacatccttacgatttaagctctacagcttaaatctgtaccctactccccagattgttgctgcttcgcagcgcaggcgctcattccggtacagcttcgctgtggagcgcctgccttgcacacctttacacatccttacgatttaagctatacagcttaaatctgtaccctactccccagattgttactgcttcgcagcgcaggcgctcatttcagtacagcttcgctgtggagcgcctgccttgcacacctttacacatccttacgatttaagctctacagcttaaatctgtaccctactccccagattgtttctatgtactgcggtttgttggtgttcatctcgatcttttcgcggatctttttgatgtgtaccgtcaccgtcgcaatgtccccgatggattccatatcccagatctggcggaacagttcttccttcgtaaatacatgattcggattctccgcaagaaatgtcagtaggtcaaactcctttgtcgtgaactgcttctcctcgccattgacccagacacgtctcgccgtcttatcgatgcggattccacggatctcgaccgtatcattctcaggcgtattgctaccgatcagccgctcatagcgcgccagatgtgccttcacgcgcgccaccagctcgctcggcgaaaatggcttggtaatatagtcatccgctcccagtcccaggccgcgaattttatcgatgtcatccttcttcgccgacaccatcagaatcggcgtgtttttctcctcccggatctgcttacagatctcaaaaccgtcaatgcccgggagcatcagatccaggatgtacatatcaaaatcttccgtcaacgcccgtttcaggccgacggttccgtcattctctatctccacctcaaatccgctgagttccagataatccttctcaaggtctgcaatctccacctcatcctcaatgatcaatactctgctcatatggcacctcctgatattttcgtaatacaaaatacatcacggttccgatggactccttgcttgtcgcccagatcttaccgccgtggtcttcaataatcttcttcacaatcgataatccgataccgctgcctcccgtcgcagaattgcgcgacgcatccgcacggtaaaaccggtcaaaaatgtaaggcagatcgcgcgcggcaattcctctgccgttatcttcaatctcgacctggataaaatcaccgacatccttgatccggatattgataaatcccttctgcttgtccagatatttgaccgaattccccacgatattgttaaccacgcgctttagctgctccgggtctgcaataatctggacatcctcgtccgcataattaaaatatgccagtccgatgtttttcgcctcgagatcgagcccgatctcctcaatgcagtcattgaaatactccgccacattcagctttgcaaaattgtacggaatgcggttggtatcgatcttcgcatacaatgtcagttcattgatgagcgtatccatctcattcgccttattataaatcgtccggatgtacttgtcacgcttttccggtgtatccgccacaccgtcgataagtccctccgcataccccttcacagctgtgatcggcgtctttaaatcatgggcaatattgctgatcagcgccttgttctcacgctcaccggaaagcttttcctctgcgttatccttcagccgctgccgcatctcctcgaaattgcggcagagctccccgatctcgtcattcgtctccacatccaccgtaaaatccagattaccgtccttaatgttctgcgccgccacctgcagcttcttgatcgggttgataaaactcgtataaatccatacggtcagcatacatgctgtcaggattaagatcaggataatcgagatccccacatccgccatcaggctcttcaactccggcacggtctcctcgaggatcgtgataataaaaacactgccctggcttccgtccgtatacacaaaatcaatctgcttgatcagcgcctgcttgtctccgtcgacatagatgccggtgtctgccccggactcttcccctccgtaggccggcagatccgtcagcagcgacgcctccttatcatctcccacatagatcagctcgtctcccctgcgcacgacaagatacgaatacttctcgcgcagagtgtcattcatctgctccagaaacgccttatcctccagcttatccggatcctgctttgaaagatccagaagcgtctcaaaggactcgcgcgtaaaacggctgagcagctgcatggaattagaaaaataactgtaatcgtcactctccacgccgtatgtctgttcaatcgacttcagctggatcttctggaatccgaaaagcaccgccaccgcaagaagaatggggataaatatgataatacaaaatgaaatgataattttatttttgaacttcatgtctgctttgtccaccccgcaaattcccgcaaaaaaacgggtcatagaactgtaattctatgacccattataacacgaaacatccaaaaacctatttattttatgtaaaattgtctaaacttttcataaaactctacaaatatttctttaatgtctccaccttatcgactgcctcccacggaaggttcagatcggcgcgtccaaaatgtccgtatgccgctgtctgacggtaaatcggtcttcttagatccagcatcttgatgattcctgccggacggagatcgaagttttcacgaacgatttccaccagtttctcgtcagaaagctttccggttccgaaggtgtctaccataaccgatgtcggctgggcaacaccgatcgcataggaaagctgaatctcgcatttttctgcaagacctgcggcaacgatgttctttgccacataacgtgccgcgtaagctgcggagcggtctaccttggtgcagtccttaccggaaaaagcgccgccgccgtgacgtgcatatccgccgtaggtgtctacgataatcttacgcccagtcagacctgcatctccgtgcggtccgccgataacaaaacgtccggtcgggttgatgaagaactttgtctgtgcatctaccagttccttcggcaggatcggatcaaacacgtatttcttgatatcctcatggatctgctcctgtgtaacatcatcatcatgctgtgtggacagtacgacagcttccagacgaagcggctttccattctcatcatactcaacggaaacctgtgtctttccgtccggtctcagataggaaagtgtgccgtccttgcgcaccctggtcagctgtaatgccagcttgtgtgcgagagaaatcggatacggcataagctccggtgtctcgtttgtcgcataaccgaacatcataccctgatctcctgcaccggtatccagttcatcctttaacccgccctcttttgcctcgagtgccttgtctacacccatggcaatatccggtgactgctgatcgagcgctaccataactgcacatgtatttccgtcaaatccggtcttcgcatcgttgtaaccgatctcgttgactgtctgtctcacgatcgccggaatatccagctttgcctttgtggtaatctctccggttaccagtacaaatccggtacagcttgccgtctcacaagccacacggctcattggatcctctgccatgcacgcatccagaatcgcgtcggaaattgcatcgcagactttgtccgggtgtccttctgtgacggactcagatgtaaataatctcttttccattccttattactccctttctcatcatgtaaaatgacacaaaaaaaccacttgcgaaaaacaagtggaagtgacgtatagataatcaaatcctcttattgttcgaactatcgcggatatcgcttctgacagcgctcatccataacagtatttgctcgctcaggttggcaccttccgtagaggggttgccgtgacttcacagatcctatgtatctccatcactctgaataagaaaatttacacacaatattgaattttcaaatctacgtctgatacgttacacccctttctccgctatgtcaagctttttattgactttcttttttcaaacttctatactgaaagtagttgtagtaaatataggtagaaggggtaagcaaatgaaagaattggcactgtacaatttaaaagagggcatggttcttgcaaaagacatcactacccccagcggacaggtggttcttgaaaaaggaaaagaacttacgaagcagtcgatcctgcgcctttccttttataatatcaagtcggcctgcattgtggacggggaagaaaagcaggcggctcccaagtcctattcgcagaaaatcaagacttcgcagaagtttcagtctttccaggtggatcacacgatcgtgctcagtcagatccgtgtcagctttgagggctacgtgaacgagggcaagccgttagacacatcagcgctcctgtcgaaggtcgtcgaattgttccagtcctgcaagacttctctggaattgtttaatatgttacataacatgcattcctcagacgacagcgtctatgtacattccctgaatgtctcgctgatctgccggcagatcggaaaatggatcaaggcagacgacgccactttagacatgctgacgctcgccggactgcttcacgacatcggcaagctcaagattccaacagagcttctcaacaaaccgggcaaatacaccgacgaagagttcgcgcaggtcaggctgcacacccagtacggttacgaactgttaaagccgcttccgctggatgcacacatcaagctcgccgcactctctcatcatgagcgctgtgacggcaccggttatccaaacggtcttacgacgaacgatattgatccttatgcacgcgttgttgcgatcgcggatgtttatgatgccatgacgaccgcccgctcttaccgtgctcccctgtgcgcttttcaggttatcgccaactttgagcgcgacggtctgcagaaatacgataccaaatgtgttctcgcattcctcaaccggatcgccggcacctaccagaaccaccgcatcctcttaagtgatggtcgtagtgccaacattgtcatgctcaacgacaagcagctttccagaccgatcgtgcagttggacgacggttcctgtattgatctgtcaactgcgggcgatctgcatattcaggcggttctctaaaccggcaaagccgtgtccgaaagcacccagcgcctgcgatagccggcagaagataagctgtagactgggaagttagagaaacgcaacgttccaaatgcaaccggcagcgacgattctgatcgtaaaatccggtatttctaaccatgccgcgtccggcatcctggatgagctgtgtctttccaagtttggaacattccacgcggcgtgtccgcaacctgcagacaattttaggacttacgtgcagcacggctagtgctgcttgtactataagcatgtagatacattatgtatgtatccgcatgcttatttttattataataaaaggcggataaggctagtgcggtgggacatagctcccgttttttagagtttattccgcctcttattataagcattcgtttaaacaggttggattaaatacatccgtgtaacgaacaagtctgaatggtaataagtctggcggagaaaaggaggatttgcatgaaacaaatagtaagtgtaggaatcgatgtatcaaaagggaaaagcactgtctgtgccatgatacatcctaatacgattattaaggaatcgtttgaagttttgcataccgtagaagaaatgtcaatgttagctgattacatcggatcacttgatggagaaattcgtattgtaatggaatcaacagggcattatcatcttccggttgcacaatttctgtatcaaaaaggcttttttgtatgtgttgaaaatgcatatattatacgacaattttcacgcattatgctgcatggcgcaaaaacagatccgcttgatgcaaaaaaattagcaaagtacggtttggcatactggagtgaactgaaaccatataaatttcatccaagctgctacacagaattaagtctattatccaagcagtatcagacatacataaagcttttgattgttgctaaacagaatgtaatacatttgatggatgagatgcttcctggtttcaaagaagcgctggatacagcaagcagtgttcaattctcaaaagtgaaatatgtggattttgccaaagaattctatcatgttgatatgataaaaagcatgggaaaagaaatttttcgagagaattataagcaatggtgtaaagaaaaaggataccgtttccaatcagaaaaggcagacgagctttttcacttggcggaagacggtatccctacactaccaacagagttcccttcaaccagactctgtatggaagtagcaacagagcaagtaagccaattaggttatgctctagaacaaatattatcacaaatgcaaaatcttgcaaagactttaccagaatatcaaacgatacgccaaatgggaggcatgggtgaaaagttatgtgtaaggtttatagctgacattggagacgttcgacgtttccataatggcaaagcattagttgcttatgcgggaattgatgctccgccttatcaatcaggacaatataccggcaccaaacgtagaataagcaaacgcggaaacagtgcattaaggaaaaccggttatgaggttatgaaaagtctgaaatcccatccgcccaaaacagatactcgtgtctatgattttataattaaaaaagagaatgaaggaaaaagtaagaaacaagccaaaatagccggtttaaataagtttttgcaaatctattatgcaagagtaatggaaatatataagaatatagtatagttgcataagaaaaaagcctgaataatcaggcctatttcttatgcaaaaaaatcaaaaattgtgttgacatctcttaacaggtctaggaagtccgcccattgtctgcgagttgccggacacactccggggactgtccaaacgtggaaagacacagcattcgatgccggacgcggcacggaagaactacctggattttactccaaagaatccgccgctgccggttacattggaacgttatggttccctcattttttgtctacagcttatctcctgtacactttcccggttgctgggggctttctaacacggctttgccgttttaggagtcagaaccgacacgaaccgcaaacgcccgtccatccatttcccgatcgccccgatcacctttcccatcgtaaacgctgccagaattgttccgattccaagtccatccagatgtcccaggaagaagatcgtcatgccggcggtcaccgccagacagatcacatcaaacgagacctttatgttggaatacgcggcgcccgtaatgtccgccagttccctcgggaacagatctgtcggtatgatcggcagaccacagcggttcgacagtgcaattccgatgcagatcaacagatagctgattgcaaaatagagaatacggttcggaagtgtaagcggcagaagattgatccacgccttatgcacatccaaaagttccccgaacacaaatcccaccacaaagctgaacagatactgcggcacaaaccgttttcttaaaatcatcaggctaagcaccaggacgccctggaacaggtatgtccatgtgccgagcgagatccgcgtaaacacttccgaaaacgcgaacggcacgctcgagatggcagagattcccgcgccggagtgcagcatcagcaccaccccgaagctgttaatcagcactgcaacaagcagtgccagttctcctctcacagtatgtaactctttctgttgtatttcctgtgcttccattgttatcctccaagtctgtcttccgcgctatcatgtcaaaagaacgtttttttatttcataggaaggttctgctttcttgtattaacgtgccacagtatttcctatgaaataaaaaatgtctgctgcgggatcccctcccgcagcagacctgatggttcaaaacttccattctatgatactttcagtgtaaacttctgtatttctttttcgtcggaaactttctcaatcaatgccccaagcagtgacagcttctgatcaaatgcctcgtagccgcgctcaatgtaataaatatcgtccacaacagtaatgccctctgcgccaagtccggcaatcacaagcgccgctccggctcttaaatccggcgcattgactctggcaccggtgtactggtccacaccgctgataatagcgatgttgctctccaccttgatgcttgcacccatgcgtgtcaattcatccacatacttaaaacggttctcgaaaatgctctccgtcacggtactcgttccctgggccactcccagcacaactgtcatctgcggctgcatatccgtcgggaaacccgggtaaggaagtgtcgtcacctgtgtatgacgcagcggcttcgatgccaccacgcgcacagcgtcgtcgaactcctccacttcgcatccaatctcaagcagctttgcgctgatcgcttccagatgtttcgggatcacatttttcacggtaacgtcacccttggtcgccgctgccgccagcataaaggtacctgcctcgatctgatccggaataatcgaatactctgtcgcatgcagcttctccactccgacaatccggatcacgtccgtaccggcaccgcggatattggctcccatgctgttcaggaagttggcaacgtcaaccacatgcggctccttcgccgcattctcgataatcgtcttgccctctgccatggacgccgccatcataatattgatggttgccccgacagacaccttatccagataaatgtgcgtgccggttaacttttctgcataagcccgcaccagaccatacttgatatccacatcagcccccagagccctaaaacccttcatgtgcagatcgatcggccgtccgccgatgttgcatccgcccggaagcgccacttccgcccgcttatatttgccgagcagtgcgccgatcagataataagatgcgcgtatttttcggataaattcattgtcaacattaaaatcccggataaaagatccattgatccttaccgtgtgagcatccagccgctctacccgcgctccaatctcctcgatggcattgagtaaaacgttggtatctctgacattaggtacattttctattgtaacggtctcatccgtcataactgcagcagataagatcgcaagcgccgcattcttagcgcctccgatttccacttctcctaccagcggatttccacctttgatcacatactgttccatatcacacctctatgaacgctttatacaaacacgtaattatactagtgcttacatgcttttgtcaagtaattcttaagttcttcgttcatcaaccatatagtgtacattataccataaatttcatccatttgtacagcatacaactatttccagtctgtgtcctcttcccatcagttgctgatgtatttgagcggatccactgctgaaccgttgatatagatctcaaaatgaacatgcggtcctgtagaacgtcccgtacttccacttaacgcgatcggctctccctgctcaacatgctgtccagccttcaccagaagcttactgttgtgtgcatatctcgtcagtctgccatccgcatggctgatgaccacgttattgccgtagccgccattataggacgcagagattaccgttccggcacaggatgcgtacaccgtcgtcccgatcgggcatgcccagtcaacgcccttgtgcatacgtccccatcgtctgccgaatcctgacgtatatcttcctccggaaatcggtttgatataggtcggcggaatgatggtaccgcgctcaatgactgccgcctgtgacgccaccataacgttctgatgtatcatctcgcggcttgtttccacaccgttctcatagaccacaacgtcattgcgctcccggtgtcccgtcgttccctcctgctgtacaacctcttttgtcgtataccaggaatcgttgtctatgatgatcggctcttccatgtagtcctcctcatagacctctccttttgttacccgaagctgcagatccggctccggcaccgcaatgatgagttcctgaccgtcccttatcatcgcatccgcgctgtccagcccgtttaacgccacgatcgacgacactgtcgtatcatgatccatcgcaatcacggagagacagtctccgctctccactacatatattttattcgattctttctcttttgttacttcggcaacctgttcatccacatctgcaatctgatcggcatcgacatagttctcgaacacattcacccgctccacaaattccatatcaaggatgcctgtctcatatgtggcttttggatctgcaaatgcctcctccagcgtacagatcacataggcgctgattcctgcctgcggcagagaagcctgtgcttcctccagcaccttttcatccgctgcagcccctgcgtcccttctggcaagagacgctgtcagaattccgctcacatgggagccctgatccgcaatgaccgccccgtattcatccgccgcatccacagaagccttcactttttccagaaaagactccacctcgtccatcgtcgcaaagttggcgcggtattcatcgatcgccactgtatagacgcgctgcttttcctctgcatttttctcacttagtatgttctctacggcttcttttaattcattctccgacaacaacttctggaacggttttctacactcctcactgctccatacgacttcgccgctgattctctccccggtcttttgcgtcagttcctgtctcgcctgacggacgatgtcatccatatcagtgttctccggcgcatacccgatgatgcggtcatccacgcgcacctgccgatatgtctgtccgattccaatctgcccggaaaggcaaaaaaggactccgccgaccgccaggactcctaccgcagctgcctgccagactgcctgttttgtaaacgtttgtttcttcattgaaagcgttccttcaattccataattttctcaattgtctgttccacgttcaaatgatgttcatccacaatcacatccgcatatttctcgtacaaaggcacacgttcctcatagagatcatgaagtgtctgtccgtctcttaagacaacccctcttcccttgatgtccgagagcctgcgctccaattcccggtacggaagtttcagataaaccaccgtaccgatccggccaagatgttccatcgcttccgctccgtacaccacgctcccgccggttgcaataatggcatgttccgcctcgatcccgctgttgatgcggttctccaccttaaggaatccctccggtccgacttcagcgataatctcacgcagaagctttccttccttttcctgtatcaccagatcggcatcaatgaactggtatcccatcacttttgcaagaaccacgccaacggtactctttccgacaccgggcattccaatcagtatgatattctttttcatgtgtaccttccttattcactgtggctgttccaattttttcacaatctccgaaaatcccataaaatgggacgcctttaccagaatggtatcccccggtctgcggtactccagcagcgcctcctccagcgcctctttgtccggttccgcatagaccctggtctccggcgctacacgccgcgcctcctccgcaatctcccctgcaagtgttccggtcacaaacagcgcatcgatcttcttccccgcaaagtgtgtgccgaccattccgtgcagcttcttttcctcactgccgagttctcccatatcgccgagcacggcaatctttcgtcccttcgcctgggacagcacgtctatggaagccatcatggacaccggattcgcattgtagcagtcgtcgataattgtgatgccgtttttccggatcagattactccgcccgccaatcgtgtgcgcatgctcaattccaagcttcatctcctccgcatcaagtcccagccgtcttgccacgcagactgctgcaagcgcgttgtatacattgtgctcaccagcaatcgggatcaccacctcaaactgctgctccggcgtgtgaatgaccgccttcgttccctcaaggccgatcgcctccacatcggtcgcgtacacttccttttccgcgagccgtttgctgccggtctctgtctctgccgtctttgcttcctgtccgattccatagaacaccgccggtctgccattcaccatctttttgtcacagagcttatcgtcatccccgtttaatacggcgatcccgtccggtgccagatgctcaaagctctccgtcttcgcctttaaaatgccgtctcttgtgatgaggttctccaaatgacataagccgatattggtaatgacgcagatatccggctgtgccatctctgcaagacggtgcatctcaccgaactcagagattcccatctcgagcaccgccacctgatgttcctcccggatcttaaagatcgtcagcggaagtccaatctcattgttcagattcccctcggtctttaacacgcggtatttctcggagagcaccgacgcaatcatctcttttgtgctggtctttccaacgcttcctgtgatccccacgactttgatgtcgagtgagcggcggtagaacgccgcgatcttcttcatggcttcctccgtagagtcaaccagaatatacggtcctgccggatgctcgagccgctgctcggagagcacggcaagcgctcccttttcaaaaaccgccggaatgaaatcatgtccgtcgacgcgcgctccgcggatgggaataaacagatatccctccccgaccagacggctgtcaatcaccgccccctgaatctcctttttgcggtcgcattcttccccgatgtatgtaccgccgcacgcctgcgcgatatgctccaatgtcatatttttcataatggctcccatttcagacttcattcttaattcttgtacttgcgcatggaactctcgatcagcttctcacagagctggttgaaatccacgccggtcacctttgcctcctgcggcagcagactggtcggcgtcatgcccggaagtgtgttcgcctccagacagaaaatgtgatcttccgcatccagaaggaagtctgtgcgcgagtaagtgttgagtccaagcacctctgccaccttctctgcatagccctgcatttcctttgtaatctgttcggacagctccgccgggcaggtctctaccgtacttcccgctttgtatttgttcttataatcatagaagccttccaccggcgcgatctcgatgatcggaagcgcctgaaaatcgatgacgccgacagaaaattctcttccttttacatattcctcaatgaccagctcattctcccagcggaacgcctcctttaatgcctgctcgtattctgccttgtcgtgcacgatcgatacgccgatgcttgatccgccgctgcacggctttaccacgcacgggaaatgaattccacaggtctcgatctttgccgcatcctcgccacgctttaaggacgtgcctctcggcgtcgggattccattctcgaggaacagctgctttgccattcctttgttcatggcaagcgcactgcccagatatccggttcctgtgtagcggatgccaaacaggtcaaacgccgcctggatcttaccgttctctccgttctctccatgaagcgccataaacacgatgtccgccatccggcaaagctcgatgacattcggtccgaagaaattatccgactgatcctttctctgcgcctttactttttccaggtccggcgcggtctccggaatcgccgccaccttgacgctgaccgcctcggctctgtcaaaaattccggtaagatcttcttccttatcgctatatcccataaaaacatcaagtaaaattacctgatgtccgttctctctgagtgctttcgtaaccatctctcctgtcttgaaggacacatctctctctgtgctgagcccccctgccaaaacaactatcttcatggtatccgtctctcctttttcaaaacttttctcgctttatagtatacctttttcgatctgatgacaagaatattccttgttttttcaaagctctgcccctgcgctgcgacccctttcctgctttttatctacgctcttccgctatacactcacgtctgctgtattctgccatccccaaaagccacagaaaaacctgcctcgcaatgagatccctcccgtgaatcatactgccataatgataaatcatctgctccgcttccagctttcttcccaccgcaagcgcggtcagaatctgttccaataattcaatccgttctccctccaatgggtactgatatgcaatataatccataaaccccggataattctgcatcatatccaccaatacatttgtatgtccgtagcttttcctacttgagcccttttcttttgtttcacacatgattaacttttctacctctcgcacacgcagggcacgcttaactacaattataagatactttagtactaactgtacacccctttgcacaaaaaattttacagaaagcgccctctgtcagctcaaactccttttttctccacaaaaagaagagggagtgccgcatctgcaatacggttctccctcttctttctgtaaatatatcagttcattatgagacagcacatctcaaacgctcttaattctccggctcgatcagtccgtaggtgttgccttttctcttatataccacattgacatcttccgtctctgcattgatgaatacgaagaagtcatgtcccagcagttccatctgcacacatgcatcttctggatacatcggcttcatggagaacttcttggtacggatgatcttgatctcctcatcctcgtctgcggctccatccaggaattcctgcttaaatacagcggatgcattctgctgctttgtcaccagcttggttctgtatttcttaagctgacgctcaatcacttcctccacaagatcaatggatacatacatatcgttgcttacctgctcggagcggatataatttccttttgccgggattgtaacctcggctttctgtctctccttctccacgctcagcgtcacatatacatcggtatccggtgtaaaatacttctcaagcttgttcagcttgtcctctactgctgccttcagcccctctgttaattcgatgtttcttcctgtaatcttaattctcatgatgtccaacccctttgccgtttatttgatacaagatatatcatggttatattataacatattttggctttatagcaagaaaatttatgcatttttcataattttttctgaaaattcatcaaccaagcgtcagtgcgagataaccgtcgcccgcaaccggcagatctgccatcgtcttcggcagccagatcatgccccgctcccgtccgtacgatgctgcgctggttcccgtctcttccataagctgcggaagcacctgtgagagagcgtcgtccgacagcgttgtctccagtatcacgagctctttttcccggatatcatacatcagaatatccctgtcatcttcctgctcattccgtgtgtttttatcctcacagctgactgccgccgtaccgccgccgcagcttgccgcgagttccatcgcataggaaaccgcatccacatcccagtgtacatacccttccttcgcgcacttttcatcccggatccgtacatactcctccggtgtgacaggctccatgcatgcaaccggctccgtgtcctttacctcgagcgccgtaatgtcactgccgctcacatttttgcgttctccctggaatgcattcttaaatcccagattttcatagtaacggatcagcgactcctcggccggcgacagaatgagcggcacctgatatttttcttctgcaaagcgcagaatctgttccgcaagcttctgtccccggtattccggcagtgtcgcaaccgcatacacatagcgcgcgtccacatacgctccgttgcacaggtactgcaccggcagaaaacttgccatcgctaccggtcttccatcccggaaaatcacgagcatattctctctcgtcattcggtgcttcagataaaactgaatataatcttcctcgtcgccaaagcatttctgccagatttcctgaatatacggcgcatcccgcttggggtccgcatagaccaccccgctctcctccagttcgtattttggaaggagaatatccggataataggaaagctttgcctttctgagtccgggatcgccagtgtcctcctcgcggttgacatacgcatacccttcacattcatgcaggacaaactgctggttgatcatcggatacgctccctgaagatccggatacgccttttcaaagtgcacaacgaacgtctccgagttcagccgctccccgatcgaaaacgcgacgatctgcccgtctctccggagcactccgccgacaagtcccagctcctgcatatgatcaaacgcctcatggagtaccgagatctcctggttcatctcctcattccacttttcctcgcgcatgtgaatccacgtatacgtcatcgtgcggcattcttctatgttttcagctgtcatcggctcataagaccagtctcccgaatctttaaagcgggcaatgtgattgcgctttccgtgcagtttcttgccggcaagcgtcgcaagcttctctcttgcatagatatagtcatagtcgttccggtctccctcgattaagaaccttcccgggaaccactctagcatctgcgcgcggtcctgctcgctggcaggtgctatcagcagctggattccctcctcatggcaaatcgcaagcagctcctccaccgccgcttttttgtcgccgtttccaaccggaaatgaaaagcagtgaatctctccatctataaaccgaactaccaggcagccgtgaagctccgccactctgacctgatagacatttctccacataaaattatttgcaaacgagtattcgcaggcattccgatcatcctccgcgaacttctgatccatccatgccttatcctgcagtgttatctcgtgaaatactgtttcttctggtttcataaatacctcaattctaaatttttaaaaggcaaaaaagaaccgccaacctgtgttgacggttctttttctcagcccttcatcaagaacttaataattttctctgtatcttccggctcgtaagcgacaagctcaagctccggaatctccacatccgtctttaaaatactggtaagtgacacatactggcaaagctttgacttgaggttcagtctgtccccctcaccggtaatgagttccacttttccctgacaggagtctattaccttaaaaaatccgtcgatatccgtgatgttcttgatcttcataatgcatgctcctttcttaatctgagtctctatctacactataatacgaaagtacctcttctgcaagttctaaatcgtaaacctggaaatatgttccttcagcgtctcggccgtgttttccatctccttcgagtctttctgcacatctgcactgttctcggagacaatctccgccagttcctgaatgctgaccgcagtcgcctcaatcttctccgcggatgccgactgttcttccgtgatagctgccatattggacgcggcatcgtttacttcatgcactttctctatcattccctgcacgatccgttccggcagtcagacgtttctcgcctgacgcattgcctccagaatgatgctctccgcacttttcgcctccgccttggtgagctgtggcgtatcttttaatgcataatcaatgccgagattgtcatatttcactttacccatggagtgatacggaagcacctccagcttttccacattcgagagtgtcgcaagaaaccggcccagagcctccagttcttccctctgaaatgtgatccccggaacaaccacatgccggatccagaccggtatctgtttttcatccagataccttgcaaacgcaagaatcttctcattgtcctgtccggtcagcttccggtgctcctccgcatccatatgtttgatgtcaagcatcacaagatccgtcactgagagcagcagatccaccttctttaagcgttcccgctcctcctccgacgtgccgccacacccggggaacataatgcccgacgtgtccagacaggtatgaatcccgcgttcctttgcccctgcaaagagctccgtcaaaaaatcaatctggagcatcggctctccgccggtcgcagtgattccgccggtccggtaaaacgaccggttgcgctccatgcgcgaaaggatctcctccgcgctcatctcctgcccgtcctccagatgccaggtatcgggattatggcagtacaggcagcgcatgggacatccttcaaagaacaccacaaagcggactcccggtccatccaccgttccaaagctttccatcgaatgaatttttcccataaagtcctcctttttaatcccatccatctgatattcataatgcaatcgcgcgagccggcttatcccggtgtcccagccgcaaaagcagcagggcaccggttccggttcgcgcgatttatcctgtctgtatcacttccacatgaattacatgcgctcgtggaaggttcttgcaatgacttcgtcctgctgctctttggtcagcttgataaagtttaccgcatatccggaaacacggattgtgagctgcggatactgctccgggtgtttctgtgcatccaaaagcgtctcgcggttcaatacgttgacgttcaagtgatgtccgcccttctcgacgtaagcatccagcagcgccacaaggttctgctcctcgcccttctcatccttgccgagtgcatccggcacgatggtaaacgtgttggagataccatcctgggaatccataaacggcattttcgctaccgacgcgagagatgctaccgcaccgttcgtgtcgcgtccgtgcatcgggtttgcgcccggtgcaaaggcaacacccttctttctgccatccggtgtcgcacctgtgttcttgccgtaggatacgttggatgtgatcgtgaggatcgatgtcgtcgggattccgccgcggtaggtgtggttgcccttgacatagccgatgaatgtgtgaagcacttcctttgcaatgtcgtcgacgcggtcgtcatcatttccgtatttcgggaagtcaccctccacctcgaagtctacagtgattccgttctcatcgcggatcggctttacctttgcgtacttgatggcagacagggaatccgccacaacggaaaaaccagcgattccggtcgcgaaccagcggcgcaccttcttgtcatgaagcgccatctccagcttctcgtagcagtatttgtcatgcatataatgaatgatgtttaaggcattgacataaacacctgccagccacttcatcatatccttatacttatcccacacctcgtcgtaatccaggtactcggaagtgatcgggcggtacttcggtccgacctgcttgccgctgatctcatctacaccgccgttgatcgcgtacagaaggcactttgcaaggttggcgcgggcgccgaagaactgcatctccttaccgatgcgcatggaggatacacagcatgcaattccgtaatcatccccgtgtaccacacgcatgatgtcatcattctcgtactggatcgcagagtgcctgatggatgtctgtgcgcagaaacgcttaaagttctctggaagctgtaccgaccagagcacggtcatattcggctccggcgctgctccgatgttgttgagtgtatttaagtagcggtaggacatcttcgtcaccatatgtctgccgtccacaccgattccgccgatcgactccgtcacccaggtcggatccccagcgaagatggagttgtactccggcgtacgtgcaaacttcacgcagcgcagcttcatgacaaactggtcgatgatctcctggatctccttctctgtgaacgttctttccttgagatcgcgctccgcatagatgtcgaggaatgtggaggtacgtccaaggctcattgccgcaccgttctgctccttgactgctgcaaggtaagaaaaatataccgcctgcgtcgcttccagcacgttgttcgccggcttggaaatgtcacagccgtaaatctttgcaagctctttcagcatcttgagtgcgcggatctgctcggaaagctcctcacgctcacggatgacatccgaatacatgatcgtacgggtcgttgcgagctgttcttccttgtcctcgatcaggcgatccacaccgtagagtgccggtcttctgtaatcgccgataatacgtccgcggccatatgcatccggaagtcccgtgatgatgtgtgccgaacggcatgcgcgcatctccggtgtgtaagcatcaaatacaccggcgttgtgtgtctttctgtgcgtggtaaaatattccaccacttccggatctacatggtagccgttatcctcgcaggctttcactgccatgcggattccgccgtacggctgcagggaacgcttgaacggcttatctgtctgaaagccgacaatcttctccttgctcttgtccagatagcccggtccgtgggatgtgatcgtggagataatcttggtatccatatcgaggacaccgcctgcctcacgctcctgcttcgacagttctaacacttcgttccataaatctgtcgtatcctgcgtcggtccttccagaaagctgtcgtccccgtcgtaaggcgtatagtttttctggataaaatctctgacattgatctcttcctcccagcttccccgctgaaagcctctccattcattctgcatgattcttcctcctgcttactttgtaatgtgattatgttccctgcccgcaggcagcattgccaaaacatgatattagttagttgcggctaacctttacgactatagcacagcacacttttccctgtcaatatcaagttttgttgccaggcatgtttgtcttgtcttactctcagtgggtattttatgctttttgaaccaaagcatcttttgtcttagagatgggaatcccgggtacttttccgataaaaagcccctgattcaaaacaagccgactgcccgggtacattcgcccagacggtcggcattagatacgttatactccatgtggttcttccacttgttccgtcagtcatataacatcttaatcttacagtatatgatgatttttttcaataggaaaaattatacaaaatcatagaacgccattccattcttcgtcgagttcttcacgtgatacagcgcctgatccgccgcccggtacacatccacgaacgtgcttcccgattccggcacaaatgcaacgccgacactggctgtcggttccttgctcaggtgcatccgttctttttcggcgcgtacctccgtaagaagcttttgaatcttctcttcaatctctctccggtcgccgatgtctctgaggaaaacagcaaattcatcgccgcccatcctgccgatacaggaatggtctccaaacacttcgtttaagattcccgccatccgcatcagaatcatatccccgactccgtgaccgtaaatgtcattgatctgcttaaaattatcgacatccagaagaatgaatgcatcctcctcatcgccgcctctctcctgaagcgcctcgcagacatgcttctccagcgcgccgcggtttagaagcttcgtaaaggagtcctgcatcgcctgctccctgagcacctcgttctcctgccggcacagttcctcccgctccatccggtcggtaacatccataaagctgacatagcagagcggtccctcctgcatctgcacattcaccctgcttaatatccacttgtaaccaccgttcttcgtctgcggtcttgagagcacctcaaacggcgtcccggaacgaatctgttcattgtgctcgcggatgacctcccgcagatcgacatccatcagatccgtccatccgtcctgcatctttctgatatactcttcccgcgtgtatcccataatctcacacgccgtgtcgttgacatagtaaatcttgcgccgaaatccctctttgctcacaatcagtcccatcggaatattccgcatgaccttgcgaagcactttctcctctaacgtatagctttccatataccctctttaaaacctcttccccaattcccctatcgttctcatgaagcatactacggagtacagtataatactttttacagcaaataaaaagtccctttcgtctttttatataaatgttacagattggaaagcttcttttttgttatatcacacaaatctattgccgcataccccactcttttcctacacgcacagctctttttcacgaaacagcgcgtccaccagacattcatactcagcaacccgctcacattttcggattttttttagacgctggtccgcatccgcaaagttctctccccagtacgcccacagttccttcatcttaaataaggtatttttgtccccggacatctgctgccggtatccctccaggatcgcattgtgaaaccggaaaaaccgctcttttcgctcctgcttttcctgtctgccgccggaaagttcctccagaagccaggggtgctttatcagtccccggccgatcatgaacttatccaccgacggaaagccctcccggatgtgcgccgcggacgctgcgtccacaatgtcgccattataacagagcgaatgtctgctgtttttctctgcccgtgcaaatgcctccagattgacccggttcttataaaaatcggtctgcaccctcgggtgtacgatcagttcttctaacggatatttttcatatatggcaagcagccgctcccattctgcagggttctcttttccgatccgtgtcttgatggagatccggagcggacatttttcaaaaatctcttccagaaaatgatccagctcgtccggcatcgcaaggaatccggcgccgcgccctcttgccgccactgtgcccgacgggcagccgaggttcaggttgaccgtatcgtacccatactcccgcagaatctctgcgatcgccagaaaatcttctgcgcggttcgtaagtatctgcggaacgaccgccattcccgcattgtgttccgggcagacgtcatttttctcccggtgtccaagctttttattcgccacaaacggcgtaaaatagcgttcgatcccgccgtaatattttgcgtatgcattccggtagacatatccggtgacaccttccatgggtgccatataatactttatctgttccaactgtcttctccctctgtcagaaatctgtcccttatcttaatacagctcttcccgcctgtcaaatagtggaaaattccgcctttttttgctatactgctattgatacagctttcacaaacccgtttatagctcattatattcaggagaatttctatgaagtcgacattttcagacagcccgggcaatcacaaccgatggttccgcccccatttttcgcatttttgtgcgacccgtctcgggcgtttcatcaacgaatccagatatggcggtattctctatctcgccctgtggctggttgtactcgggctcgtttttactctttttcagaccatctttttaagtatcgcctataccggccggctcacgccggatgattacgaagtccttcatgtggagcagaccgaatatgaccagagtatcggtgcctacgattccggtatcatcagacgtttttccgattacctggtaaccgtgcaatatgaggttgatggaacgcgctatactgcagatctttcactcggtcaggcatttttcaccggaaaccgcgtggcacgcgccggtgcagacggctcgtctgtacttggcaccattttctataaaagttccgatccaaaacgcctgaagtacattccggccagacggcacattctcccattttcaaccggcaaatatgtctgccgggaggataccgatgattttgccgcacaggtctgcgcgcttttacagcaggaggattatggctccctcgccgcgctttcttataacggcagagatatccctgtaaccgcggaagacacagaagaatattttcatgatgatctggtgtatttccgtaaaaatgtgggggatctttcgttgctggagggaactaccgtatatcacgacaccccctgggcaaccgcagttaccatccgctattactccaaggaggcacaggagacatactctgactatctaccgatcacagtgaaggacggacactaccggctggatctccgctggaaatactgagccgttttccctgcctcccctcgaatcaatgcagatgcagtgcatttttcagaagttccagttcttccatgtaaatgcagtgggaaattcggttctcccggacagcagatacgcaatccgcgaagtccatccaccggacctcagacacttcttcctcctgcagtacaaaagcttcctcctcgcggtcaagccagagtgcatacacattgctgacctggttatcgcggaacatgctgccgtggaattccctctcaaaccggaaccggcgttgtccacaataaatcagttcatcgccgttcatgtccacacccagttcttccttcaactcccgcaccgcggaaggaatataatcactccccgcaggaatatgaccggcacttgaaatgtcataacagcccggatctgaatccttattgtcgctccgtttctgcaaaaggatctgcactacgccgccgcgtctgcgaaaaatccacacgtgcgccgtacggtgccggattccctcacggtgtgccacctcccgcggcactgtctctcctgtcggatttcccttttcgtccacaatatccagcagttccatctctgctcccctccagtatgattgtattcttttcattcactatagcacacttttgctgcctttttccacatatccgaaattcttccgaagcgtctgatataattccactaaaatacataatctctctcttgaaaaaaagctgccgcattcagcagatcgtcctgtttgacgagataagtaatattatgagaagcataccgttacgatttcgggtggaatgcctagggaacattctgttcaaaaaatgcggcatttctaaccagccggtggctgcatctgcgatgatccgtgtctttccaagtttggagcactccgacggggcatgtccgcactccggaagacaatttgtaggacttttgtgtgtgtcccttattggcaccagacaacagctggcataaatgccacctttatgtcgaacaaaacataaccgcgcgaagccgctgtctgagtcggcatctgccctattttcaatagcaaatgccggcgagttcggttcgcgcggttttatattgtctgtgaagaggtgccattagggacaccagaaagtccgcccattgtctccggtgtgtcggacatgcacccgtcagtgtccaaacgtggaagagacacggaatcagatgcagtcatccggctggaagaaatacacacatttttctccaacgaatgtttcctatgcagttccacccggaatctgcatcatgtgcttcctgtaatattacttatcatcaactgccacctgtgatatgtggcagcctcttttcaactgcctctccaatctgttacagtacctgctctccgttcacgtacagatgatatccgtttgccgtgatattggaggtatcaccgtcaaagcttgtgatatagctgtcgccggtcaatgtccatgtcgaatcgtcatccagggtcacgtcaaccgtaccgccgtccccgtccggattgatggcaccctcgtagctggtgccgttcttcatggtaagtgccaggcttgaaatctcatccacgagaatattgcctgcaaactcctgtgaatccgccgtcagtgtcacatctccgccgtttgcgccctctgtgccccatccgcgggaggaagagttgccttccacgcgaaggaatacatcattggcaagtgtaaatgcgacgtccttgagtgtaatctcacaatccgtattggtaatatagaacatatctcccgtcttcgccgtaatgctgccgccctctgcagagaaggtcgcctctccgacatctgcatcaccggacatgctctggtaaatcataatgcagtgaatgttttcgtccgagtctccattataagtgttgctcatatttcctgtcacttcacagtcggtcagtgcaacggaattcttgccctctaccacaacgccctcgctggcattcgctgtcagagtcgcgtctgacacactgatacctgctgtacagtagattgccgggcttcccgttccgtttgtcacataggaaccgccgtccacattgaccgtaccgccgccccggtcgcttcggattgcggctgcggaatttccctgtgtctcgacatccagatttgcagcgttcatggtaccaccgccggtcgtctggataccgccggaattattttctgtcgtgcggattgtggaatccgaaatatttacaaccgtgccctcgccatagctgaacacaccattaccgtttgtcacgctggtattgaccgtcgctcccgtaatcgttgccgttgcgccgtttagcaccagaagtccggcattcagtccgtaaaaatctccatcctctgtgttcgatgaggagccggctgtcttctcgatcgtgatatcttttaaggtaacagtcgctccgtcgacacgaagtgcgttctcatcatcaccggtggatgtgtaagtctcactatccacctcggtatcctcggtaatcgtatttgcagaagttccgtttgtcacctcaccgcttccgccaaatccgccgcctgcatttaagttgcgcacagtgacagacactgcctggttgtcttcgtccagaactacctccaatacgctgccgactgcaatgtcatctgcatttccctcgccgcttccctgcagatactctaatgtgatcgccgtatcgtctgtcagggtaaaggtaatgctctcaccggaagcctcaaaactactgccgcccggcatctgaccacccagtgcgtctccgcttggtgcttcccccggcgctccgtttccgctgttgtctccgctcggtgcttctccgcccggtgcttctccacttggcgcttctcccggcgctccgtttccactgtcgtctccgcccggtgcttctccgctcggtgcttctccgcccggtgcttctcccggcgctccgtttccactgtcgtctccgcccggtgcttctccgctcggtgcttctccgcccggtgctccatttccggatgcatctgcgcttgcggttgtaagtgttcctacatccgctgtaatctgatcgccttcaactgctgtaacctgcacgatcacagaatcgctctggttctcctcactctgctctgttgcttctaccgtctggttctctgttgtattactgccgcatgctgttacggatgataccgtcataactacgacgcagcccaatgttactaattttttccatttcatgatcttcattcctctctgactctgtcaatgtctgttttcttttgatagggttagtatagaaagccaatgtgaagatcatgtgttgaccacgttaaattattctgaatctatttttcgcctgtttttcacaaaaaacgcaccagattgcgcaccacaccgaagattacaagcgcggcgacgctgacgtaaagaatgagattctgccagcgggcgaaccggaatcgtccattctgcacatatcctgccgcaccgcagatgaatactgccgtaagcggaagcagcagcacaaacagcaccggatggcaggaaaacgctcccctccagtcaagatgcaggagagccacacacattcccgtcacaccgcagcccggacacaacagtcccgtcactttccggaacagacagggaatggcgagccctgtgtacgacacgaatattccgtacagcagtcccgccattccaagtaacatcatatataatagcaattttttcaaacgtgcttttttcgtcatcctacatttccgatctgttatgccagcttattcagctcgttctgcatcaatgcatatgcaataattccaaatccaaaaatctggagaatcagatacaaaacaccgctgttgcttgacgggattccacggttattctttgtaaagtcaagcttctctccctgcttatatgcccagtaaatgccgtaaattccacaggtcacaatcgtcagcagcaccaccataccgccggatgttccattcacatcaccagaaaccgtatttacgtcattggtcagacacacgatccagtagatgccataaattccgcaggttacaagtgtcagtacaatacacaccgcaatatttcttctctcaatcataacaaactctcctttaaataagtatgaattcattatatcagttttttgtatattgtctactgttttcataccgtggccttttcattcctgctccatcaacgcaagcaccttgtgcaggatgcggtacagctccctcgcatcctccccggacagtccgatacagccgcccatcttccgcggaatgtcgaccgcctgctcctttagctgctctcccgcctccgtgatcgtcacatttaacacacgctcatctgcgtgatcacgctctctggtgaggtagcccttctgctccagcttctttaacaccggtgtcagcgtccccgaatccaggtacaaaagcgcccccatatccttcacattgatcctgccatgctcccacagcaccatcatcgcaatatactgcgtgtaggtcagatcaatctcatccagatatggcttgtagcgccgcacgatctccttggagcatgcgtacagcggaaaacagagttgattttctaattttaaagcatcatacttatctttcattccggcacctgtcgcttataaatagttttcaatcttttcgcggacaacatccatatccgccgtcggctcaaaacgctccaccacgtttccgtctctgtcaatcaaaaacttggtaaagttccatttgatgtccggtgtctccttataatccagatgcgtgcgctctaacatgctttccacgatcgtcgctaacggatgttcctcgtcaaatcccatatgtgttcactccgtatcttctgtgtgctgttactgctccatacatccttttacccatgcttccagttccggcttcggcatgaatccgacattcttgcctgccaccttgccgtcctttaagaataaaagcgccggaatgtttgtgatgccgtttgcgatcgcaagctgcgtattctcatcggtatctgcattgtaaaatgccacctcaccgtccagatcatccgccagttcctccagtaccggggcaagcatctggcacggtccgcaccatactgccgaaaagtccaccactgctgcctttgcctgtaacgcttcgtccatattgttgttctgaatcttcttaaccatgataatcctccttagatctctctttttttcttatccaggtactctgccgcggacagcgccgccacatttccctgtcctgccgccttgatatactgatacggctttccggtaatgtctccgcatgcaaagagtcccggaaggtttgtctccatctggagattaacctttacgtgattctcctccgtcgcaagtcccggcacgagctgtgacggtgcgatcgcgtctcttaagataaatacgccgtccaccggatgggaacccgcgtccgtctcaagcgcacttaccgtctgcgtgcctgtgatcgctttcggccgctcatgcacaacctctacggcatccgacagctgcggctcctcttttcccatcgggaaataatgcacctttccgacaatctccgccagatagtctgcttcctgctctgcctccctgccgtatccgatcaccgcaacttcctttccgcggaagaactgcgcatcacaggtcgcgcagtagctgacgccgcttccaagcagcttgttttctcccgggaacggttttcccatgacgattcctgctgccagaatgacggtggacgcctcaagaatctcgccggacgcctggatcccaaaataatctcccatcgcatagaccgcgttcacgcgcttctccgtcacctcgatgccaagacctgctaactgcttcttgtacccggcaaccagatctgctcctgaaacttccggcagccctggatagtttaaaatctgatgcgccttgctcatcttctcgctgagttctctgctgccgattaacagtacacttttatttctcactttcgcggtaatcgctgccgacacacctgccggtcccgttccaataatggcaatatctactcgttccataccgttctccattccccatatcgctctgcatctataataatgcaagaatctgtcgttccagttcgttcatatctcctgttggttcaaatcttaccactaccgtgccctgcctgtccacaaggaacttcgtaaaattccatttgatgtcgggattctccttataattcttatctattttgcggagcattattcccatcgccgccgctttcgccactttccctcataagtggacaacggctgcattgtcccgtccggccgctccacagaataatcataaatgcccatctcttaccctcctttctctttgtcattaaaaatgaatgtgtttaaattgtttcatttttaattgtgcgcaatctttttatgtttagattgtacacaatccatttaaggatgtcaagcattattttatcaatcatcgttctctgtgccggattgtcgtaaccggcaaaacgaaacattgcattttttcatcgaaagctctatgatagtcagcagacaatgggatttatagtagaagggtacggtgattttatgcatataagtttacttttaatggaacagattttggagctttttctcatgatattaatgggttttatcattgtgaaagccgggagacttcctacgactggagaaaaattatcttaaatattaatatgatctcaattgcacttggagcggttttattttttgcccaaattcatctgcctgaaatattaaacaacaccctctcaatcgttggaaatatgattggtccagccagtatgatcgtgaccggaatgcttttcgccggaatggatctcaaaaaaattttcggaaataaacgcgtatatattatttcatctttaagaatgattgttattccgctcatcgcgcttgccctgattaagctaagccggattgcggcactttcttccgatgcgccaaaaattatgctcattgtgtttctggcaatgattacgccttccgcatccacggtcacacaaatatgccaggtatatggaaatgacgcaaaatacgcaagcgccatcaatgttgtgaccacgctgtgcgcgattgtcacgatgccgcttatggtgttactctacacgtacattaatcatcggttttctattctgcatactttctttcccccatttgcatgctcaacataagaccgctctttcattcatttcagtatctgattccatcaatgtacttttctcttcttccctggatacagcttttataattctgccactttttgtatttatagttgtcacatgagcattcccccattcaaacaacctcatttattattatgttattataatatcacagttcacaaaaaacacctcggaaccaatatcccgaggtgtaatacacttttctgaaatgccgtaaagacatttgagttgtaaatcctatctctttgagaactaaaactaacgctttgagagcgtgaaaagcccacaaattcccagaactactcattactctattaatcttacaattgttactcttcttaaatatactacgcaataaaacatttcaataacatgcagatttatcactaagctattttctctttacaatagggaagttcatataatgtatccggatcaatatcaatacacttacaagcatctctgtttccacttatatcccatgctaatgtatcattcataactgtacatgtatcagtaaataccgaaatatccttcaatggtttaaaaatttctttatccaacatatttttcatatcataacatacgatttttccatcttcaaaatacacatatactgtgtagtctttcataggtactacctgaactaccttcggaaacatagacaaacacctcctatacaagtggattaattctatttaacggctttccatcttttgataattcccaattttgcatcaactcatcttgatgtaacacacaccacgctaaaatcaactttaactgtcttgatggcaaagctcccttgatgcatctagctgtatcaatttcaataattgccttatttccattatactctgcatgaaaatgcggcggattatgatcatcataatacattgtaactcgaattccataaaataaagaaatttccggcttttatttacctcctgataatctgatgacaataatattttatatgtaaaatcttctttatttattctaccacagttcttacaaaaaaacaccccaggacaaaaagtcctgaggtgtaatatacttttctgaaacgtcgtaagacgcactggattgttgaaatcctatctctttgagaactaaaactaacgttttgagagcgtgaaaagcccatcaataggggatttgtgtatggtagtgttgcatatctgttgtatgcgtagcactacctactcattcccagaactactcattactctattgaagaaaggacaatcattatgaaaaaatactttgcttactacaaccaatacaagaacggaatcgacattgcatttgatgacaatgtacttctgtttatctcatgttctgaatcagaaaaggatctccatactacgcctaattctcaaaggctaattgataatcttgcaattgatgaaccactcaaatatgctgcactagctcttgatggtgagttacaggcatgggctgatgctatggatgaggattggtgtttctaaatatttcataaatatattgcacctatattcttttcttgttatcataatgctggtattaccctattcgataggcgattagtccctcagtagagggactgtgaccctctgattacatagaattaactttctttctcagttacatttgaagttttactaaaataaaatactatttttttccaatccatctggataattgctaaccctgtcaagaaactattgtttatcaagttccaagtttcactatcaattttctcttgatatagccacacatttagacaaacaaatatcagcatatatatcaataagatttgatttttaagttgttcatcatcataggttttgctctcttcttcaaaccccaacattttattaataaaccattgattaattatttttcctaatattcgatagactactataaataaagaaaacatacaatacaatactaaaatgccatagttttcatctaccaacttcaaagcaaagatcgctagcaccaaaaaaatggtagcacagactgacatagtaactactgtcgaaaaaatatttttaaatctcatagttataaaatatgcaaacattgttcccacaaacaagattattccaaatctaaatgatttattaaatataaaacccgctattagaaaacctgttataaccagcactaattttccgtgtagattattctcaaaattaattagtactaatactattccaagcattataacttcaatacaggcagtcatatacgtaatattttcgtaagaaaacccttctactttatttttatataataatgaatatataattgtacccactgttacaagtaatacgcctataataattgaagtaatatgaaaccttttactttgattttttttaaatatcatcttctcctccgctcttttttataacaaaaacagttgctaatttttcatatattgcctgttccattttgcttttcaacaaacgtatattatcatatcgttcttcattatcttgaaaccattttaatatatctgtttcctttataacttgcctttcattatcatctaaaatttccagtatttcatcataccaattattaataatttttatcttctgctctttctgtaattcatcatattcaatacactttcctattcttgaatacatagcaggtcccaaaatcttttttatttcattttcactcataaagttacaggtacatataaaaatagaatttttcagatccacttcataattagtatctacatacttcccttcatcaaataattcataaaatgcattatagaaattgggattaaccttatcaaactcatctattaaaattaaatttgactccctccccatcatatcacgtgcgaaacttgcttttgaatgttccgatccaaatacataattatatgcttcaccagtctgcatcatagaaaattgaattcttaataacgctccacccaaagattcactaatacattttgccgtttctgttttgccaactccagatggtccatataacataaaaacggctggcttttgacttttttcttttgtcaatctatataaaccactaattatttcaatcttgcatttttcctgccccaatatattcttattcaaatcattatagattctcttaatacgtggaatatctaatttagcgtattctgatttacaatattcgatttcatctccaaattctgattgtagattttccagaacctttttgggaggattatgtacaaacaatttttcaacatcataattcaaacttattatattagtaaaattcaataaagtatgttctaataccgaaccaaaatcgtccgccttacatatcaaacaatttgcgcctatcttttttttcagaaatatttccttcactccagattctgttggatgaattctagcattataatgttgtattaattccataaaagaaacaacttcgtcattttctgtgtctattctttcctgtaacaaactattaaaatctcttttagagcctgtaaaaacaattacttcatcaatcattcgtctcaactcccgctaataaaacatcataaacatcaagttttctatttttatctgtatcatcatcagatgttttcttttcagaagaagtataatctggattatccttaggtctactataaaaatcaatatctaactctttatttacatctaattgtgataatgttgttgtcccaacttttattgcatatatacttaggttcatttttaacaaatcattaattttatagttattttttagagaattgatattaaatcgtagcacaactttacttttccctttagttcctacaaattcataatatccttttgctgactttaacgcattatccaacttctctattgctatatcaaattcacctgccggaacgcttgctccaccttttaacattgataagtatggcgacaccataacaatatatgataacgaatccttttctactgatatagtgtatccttcaaatttctttatacttccttgtgatattttgccttttctattttgtttttcatcattcaaaattcccaagaaatcagttaaaatagtgtttttaacaatattttttgccattttatttgtatttaaagaaattcccattgatgcatctgcagatgcttgagcttctaatcccaataaagccttaaaaacaccacttattcccgctttaccagaaaccgaagcatccgtatttatatttttatctgtttcttttaataactgtgttgtcttctctaatgcacctccagcaataatctgtacataatcggttactgaatcttcatcaaaatatactattttacaaattgaattttccattacattccttctttcatttgtcatattcactagcttccatagaataaatcaataaaatacaatttttacaattctccatattattaatattcatatatacaatcatttcacacaatgtcttgtatgttgcattgaaagtaatgattccttaatacaatcatacagttcttcatgtcctattgactgaagcacctttttgtcaaatgcttgtctatctgcattcattaattcatcttcaatttccatgacattacgattcttaatttttgaaaacaatgctattatctctgctgcatcttcctttgaaatcaactctggattaatcatacatattttttgaaaccctgttttacttatatctaaaacaccttgccctctaccaaatccatttgcttctattgcaaacataccatatatagaattaagcaaagcgaaaaccagttctttattagctacagaatctttatatttcatcgcaattagcctttgatcaactatcacactttcatttaattctgcgataaaaagtcttttatcaggattttccgaagtaactaaatctgctctattaattgatggcatttgataccatggtgaatagttaatacttttggctaatggttcatacttatcatttgagaatttgcgaatccatttcagtgttccttcttctccatcttcttttaactgttcaattgtcttattacagcaaaatgccttcatatttggagaagccgaatatttttttatatttctcgatgacttcaacattggatataaaaatttatctgctattgatgtttcaccatttatataaaagactttattttgccctgtacgctctcctctaatcatacttaattctttggtaattggttcaatatattcctgtatttctttaatccacgaaatattatggaataaagcattcaatgaaattccatactgcataatattatcaatatcactaagtgaatattctttcatagttgcaactgattcatcaataacttgatgaagaacaatactattaattaatgtttctttatcctcctcctcgattgtatttatatccttattagttaaccaaaaactaatccgctttgttttatctggaatactaatttctttttttcttaaaataagtatagttccaataacatccgcattattaaaccatctcttgcaattgcttataagaaccgattcgataatgtaataatactgcaatgcttcgaaaaaattttttcctatatctgttcctaaccaagagtttgaaataataatcccaagttttccgttcttttccaataactgtaagcgatgaataacacaccgcctacccaaaacagtaaacgactaccatttactttaggttttccctgctatctacatggcaggggaattctgttttccgggacattggattccacatcaatgatccccgaacactgctctttgataaattcactccatggcatcagctgttctatacctgcggacgagttcatataatccggcatatacagcagtaccatatagagatattggaaaatattcagattgtttgcttttgctgtttccacaatgctgtacattaccgcacttgccccagctccagcttctgatgtatggaacaggaaggctttccgcccaacggcataacttttggctttccgttccgcacggttgtttgaaatttcacaccggccatctatcatatagttcatcaaggtatcatgatgattttgggcatagttcaccgctttcccaagcttgcttccgccagttggatgcagtgtgccaagccagttccagaactgttcccatacaggctgttccagaatggttctttgttgttttcgttcttctgcctccagttcttttaatgtgcgctccaggtagaagagcttattgcaatacagcagtccaatttctgccgggagcagctgttccagcttctcttcatccggaataccggtatcctcgatcgcttcatcagagttaacatccagaagtttcaactttttacgtctggctgccgggactgcttcaaagaacttacgtcttgcatgtgcaaggcagcagaccagtatgacatcttcaagcctgttgtaaccctgatatccgtcacactgtaccattccatggaatccttccagaaattcctgcacacaggatcctttccggcttggctggtaatcataaaggacaattggtgtaagaccatcatttccggttgtatataaccacatataagaggtctgttccgccgtacgtcccttttcccgcagcacctgacatgttgtctcatctgcatgtaccaggtcccgctttaaaagttcttcatgcagccgatcatagatcagatagaaatagttttctgccgtataaatgatccagttcgccatggtttcccgtggcagggtaaatcccagctggttcatcagaaattcctgacgatagtaaggcattgccatgccgatcttttccattgcaacatatgcgaccatggatggggaagccgggctgtgtggaatcaatgctgtaggtatcttggattcagcaaatgtcccgtcaccatcttttctgcattccgggcactgccatttctcctgataatagtggattcgttccacctttgccggggtgatccgtagttcttcacggacaaacatttccgtcacatactccatcttggaattacaataaggacaatacttatcttcttccagcagggggatgacttccttatggatcggaagatttccatattggtcttcacgtgtcgctttcgctttgcgtgttgtccgtttgtggcttttgacgattgttgtcacagtttcttccgttttcttatcctgttttgtcttctcactgcctgtaccaaagagtttccgctggaattcatccagtgtttccctgagaccggcaattgtatctttcaggtcattgatggtttccttcagttctgtgatggtttcgtctttttcatctaaccgttcagaaagcatctggatcataaggtccttctgattcatctcactgttaaaaagtatgtcctgtccctttgaatccacggtgaatccctccctcttttttcgttacctttattgtacgaaaaggaaggcatggttgcaaatgccgtccaaaatcagactggcattatgccgaaagccagatagctcctttttttctcaaaatcagccagtttccgggattttccgtaaagttatgcacatcatgatgatgtcatgctcaactatccccggacaacgcaccccatgatttcacatctgtggatatcttccgtcaacagcctgctccggctgtagaaaaatttttcaaaatctacatattgcacaaatcagtaatccctgtctttcgcaggctgtatcgctttcggctggtcaatggaaagtccttccatcagccagcggaattcctgccttgtcagaggtctgacttctgaagcattgcgtggccattggaattttccattgtccaggcgcttctgcaggagtacaaatccatcccggtcaaaatagagggctttcatcgtattctttttgcgtccacagaacagaaagaccgcattggagaacggatccatctggaaattgtcacggatgactgccatgagtccgtcaaaggattttctcatatcagtccttcctgtaaccagatagattttctgtactctggacagatcaccgatcaaagtttccgcagggcagatatcgtatgatagatcacatccctgcctgcatgattattgattgcaactttacagccgtttatgataactgtcagtgcttcgccctctgatgttgcatctgttgacagcagtctgactggattcgatatcggtatatgcgattcttctgtaatggaaagtggtacgatttcatgtgtggcatccacgattagcctgtctgtctccggaatcatacatgatttctttctcagccttgtgacagtattataaaacgtattgatagagatatcattctgctcacaccagacacggtcagaaaatccactgctgcgacattgctgaattaatgacagccattcttcgtctgttcttctcttattacgcataagctgctcctcctgttagctaaagtagttaaacaccgtaaacggctacctttgcttaagaaaagaagagtgatacgtccgcatccagatctgaaaatagataaagtagtcgtttactgtttattgactgtattatcccaaatcttcaattaaatttggaacggtatgttattcatcgcttaccaataactcatataatttaaatggtatataattatataaatccgtttttcttgtaaatttaataccagtactatttgttatcttttctctccattgagcaatatattcctgctcatcgtcagcgactttattgtattctacaaaaggcaaatttgatacaatagttccaaattggggaatgatttcttctatatcactaccatctattggattttttattttaatcttatctcctgtctctacctcaaatatatccgttgtaaacatattaatcggtatatttaatgcatgaatatctgtaaccgcaatattagcaatctgtaatggatatgcatacttatctgacatccaagttgtcataaacgctttatctgccctatgtattctttgggctttattattaataattgcttttgcaatcgtacctgtaccagcacacaaatcagcacaatccttgttccaatcttgcacagtaatctgacacaaaatatctgccaaacgatatggtgtcgcatattgtccacgaatctctctctttgcagtatttacggtcttttcgagtatatcttgcaatactccttgctctattttttcaatgttattctcaattaaaaattgattataatcaacaatatcaatccatgtatcttctggtattacctcattaaattccaacggcttaaatacattataaaaatctccttgttcgactatatgttcaataatattatttccatcattaggagatgttgtataatcaatatcttttatggcatatgcacaattatgatactttttaattgcattagcaaacataactcgatttgtccaatttaacaacactgacttagcatatgccgaatacatattattctcatctttatcgtattcttcatgaaatgcattccaccaaacctttagtctgcgttccatctgcatattcttgctagactcaatcataatattttcagctactaactctttattccgctgaatcaattctgtcattaatccatccgatattgtatttacaatagacgatgttacaattcttccattaacaagatactcatttactgtcattacaatttcttttataataggtaaccactctgctttgtatgtagtaacatcttctcttgatttaatatgacttgttccatcccatactttggcttcctcgaaaaagccttgtttgttctgtatatataattttccataggtaaaattccatattacaaaactgttcaagcctaatgcttttgcctttcttgtcgcatctgcaatcaatgcttcatctgtaatcaatacatccggcattttaagttcccagccttgcagtattttagtttgtgcctcatcttcgtacaacaaaacgtctggaaacatacttttcttatttacagaaagcgtactttctccacctgcactcttaatctttaaccccaagccattcagcattacttttatctctgaaataattacgattgcccaacttctttcatttcttctgataattgtccccatacatttcaccttcatctttctttaaattctgctataagattttcctcttttatatatttacgagtttttttttctaatccttcccatgctaagaataatcttctttttgctacatcaatataatctatttcttcttttttaaacaatgcaacatcttcattcttttcaattccaataaaatttcgcccttccatcaatgctgccactaaaaatgatccgctaccaaaagtattatcaagtactatatcccctggatttgtatatgtccttaccatatatctgcccagttctataggcttctgtgttggatgaagaactgcaccttctgattctgctgttttaatataaataacatctgtaggataacggtctccatcacttgctacatgcactggttcaaagtctccataattaccactaagctgattttttcttattcctttatcatatggttctccctttgtcatttgaggatgatatgttggctgttttttataaaaaacgcaaacatcttcatgttttcttaatggttgctttttagcattcaaaaaattagttggctttgatttttcccatacccacttatacttataaatattaggttggctcaaaatcaactttgcagtaaaaactccattagatgttaaaacaattgccccattgggttttattattcgattatattgtttccataactcatctaaaggaatataactatcccatttattttgtgtcataccatatggtaaatcacacaaaatcatatccacacttccagctggtatttttttcatatactctaagcaatcgccttcaaacaatttgttgatcacattactcatatctatattatttttttcactattcatgccttatctcctcgaacatattttctgttcatagtatatcattttattttgtcgaacacaagttcctatatctgttttttcatataaaaatccaagataaattttaacatatatcttccgttttttccacttataaagaaaacacctttattgcactttagaagtatcacaaaggctattaaaactttttcagtcacaatagcctttgataatttttatctcccctcatacacctcccacaatctcttctgctccgctcctatcctcaatatctcctgcaaatctcttgccattgcctcaacataacatccatctgttcaactgtaccagtacgattacctgccgtaatctcccattgaacaccctcttttgagtaatattccttagtgcccacattcatatatccatacaatgaatatgaatagccatcgcttttctctatgaataccggtgccacttctcctctagaagttttccatatcatcagtcttggaaaccagcataagccttctttaatcagttccttgaatgccccaagcagcttgcccagctcattcaatattccacggaatgaatttcctgcctctattgtcttatccgcttctacctgattagcatattcttctatcgtaggtgcaaataatctgaatgacgatacaaaattcttgattctatcaagcaatttcgctgcatcttctgctttttcaatagcatttgccagctcttcatttaccgattgaagttcagatcttttttcatcgagttccattgatatctgttttgattctctactatccatttctgatagcgacttactaatccgccgcatactttccaggcatgaaatatcagactccagtttctcttttttatccgtatattctttttcaatagctttatttgccttaactgccctatccgattcttccacctgctcttgtaattgtgtcaaatgctttgtctcctgagctaccttatactctgcaacagataaatcatgatttcgacctttcgacttttcttttatctgtttcccaaaccagtcattcacttctttattcgccacctctcgaagctcatcctgcagcactcgtgataacacatctttagtaaataccttacgttttgacacctgcttgctaagacctttcttatatccatctgccacaggaactccgacaatgtgcatatgcggactgtcctcatcaagatgaaccacagcatttgcaactacaaactgtggaagcctctttctaagctcgtccagtattatctgatatgacaatttcatatatgactttatatcatcaaattgcttccagaactccctgtcgcctatttgaattattatttcaactgccatatcctgttccttacctgccacatgttcaaaataatcttcgattttccggtcttgtcgtgtctgctttttattatattcttctaatgcctcatcgaattctttatgatatactgttttcacatcatcaatcagatttgatgtaccatatatgatgcagatgttgtctttgctataatctgatgatttgtattttctcaggttatgctttgcaacagctgcaagcttagatttcgatgtaatggcacttttcttattgctcacatgagctgtatatgaaatatttcccattcgcatctccttatctgtactacctttttatctgttaaatctatcggagcagtgcagttatcatcttggctctgccacagatgataaccccctagcagttttggcaagccaaaattgcagtgggttctccgagggttttatatattatctttactattaccaagaatttaataatctgtactttttatagttgcagactctaaactcttcctagaatttagaatctgcttttccaaacattcagattgttaaactctttattccggcattacccaagtccagtaaattgttccatcttctgccttttctttatctgatgttatacccagctttttctttgccgataaaagagtatttctcttaatgctcctctttgcagcttccatcattatttcattagatggaattaccttgtttgaaccaaagtattctttgataaaattctccgcaatgtcgagcttcttttttcctcttccttcattgccggataacagctcatctatggtaatgtcatatggtcctatgcataccattccattatcctcagtcatttcaaatcctatcgcatcccctgccggagctaatgaagatttatcatgtgccattattcttatattaggtttatcacggagccttgccaccagcagaacacttctggcagttgcctgtatatcaatagaaccaagtcctctgtatgttgatttgctgccagatgccttattcatatgaccaataagaataattgcacaattatgcttttctgctattattccaagatgctttagcaccggtcttatttcatttgctctgtgcatatcaactgtagctccgatatatgcctgaatcggatcaagaatgattaaccttgccccagtctcgattattgcctgctccagcctatcatctgtcattgataattccttatctgtctcatcaataacccgaatcatggaacaatctgctcctgccttttctaatctaggcttaatcgtatcttcaattccatcttctgcggtctgataaatgatatgaataggttcatattctttatcatcatcacaggggagcggcaagcccctgctaagagctgccgctaacttgagaaccaaagttgtctttccttctcccggatctccttcaataattgttatctttccgtatggtatatatggataccatagccattccacctcctttgaaaccacatcctccatatgaataagtttcagttcaacattctgttttttaaccatattcatcctccttgctatactgcttctttgttaaaatatcctgtttcttcccaaacttttttatccggacaataatagctgaactcatttgagctccctacctttattgccgttccaaatttgagtaatccttgttgtattcccagccttacatactgtgcgtccttccctattgcacttgcaatctcttttattggtacatttctccctgtaaaagctggtaaatcaccctgatagataacttctggcatctctaccacctcctatttttatatagagcatttcttgctctgttatgttttgtattatgcagacctttatttgctctgtcaatggtttaaaatttaatgttgactattaaatattagtgtgttacatttacaatcacaggaggttgaggcaatgaataccggtaaaaagattaaattaatacgaacctttcgtggtttaacccagaaagaactaggcgaagcttgtggaatacatgaagttgcaatccgtaagtatgagcttggaaagaatcttcctaagcctgaacagcttagaaaaattgcagatgcacttggtgtcaatgttaattcattgatggaatttgatatcgaggctgatggtgatgtactaccattactatttgctattgatgaaacatttgacatttctatcaaggatttagacggagagcccggtatattcttttccaataagaatcttgttcagtttcttaaagactggcaggctatgaaagaattacttgataatggcagccagacacaggataattacgaaatatggaagactatccgcccaagtgtgacaaaggtaacccacgaataacaatcattttatccgtttgctatcagctttctagtaaatagcgaaaggatggtgcttatgaagttacccaacggatacggaagcgttgtaaaactttccggcaaaagaagaaaaccttatcaagtgagaaaaactgtaggctggcactacgatgaggcgaaagacaaacaggttcaggatatgattacaattggatatgcagctaccagagctgatggcttgcaaatgcttgctgattacaataataatccatttgataccaaggctgctaagatgacattttcagatgtctatgaagaatggtcaaagcgtaagtttcctgctatatctgaatctaatgtaaaaggatacacagcatcctataaatcctgtgaacccctttacaacaaaattttcaaggatattaaattagttgatttacagactgttattgatacctgcggtaagaattttcctactctcaagaaaatcaaagtcctgtttaaccagctatttgattatgctttgaaaaatgatatttgcaacaaagattcttcaagcttcgttgatattgttcaatacaaggatcgtaaccctaacaaatacgatagaaacaagtttgagaaaaatgaaattgagattatctgggaacaaaaggaagacaaatattatcagatagtattgatgctcctatatagcggagtccgtatctctgaaatgcttgatttgaagaaagagaatgttcatctgaatgaacagtattttgatgttatctgtagtaaaacagaaaatggtatcagaaaagttccaatagcagacaaagttctgccatattacaaagcttggtatgaatcctgccctgaatgtgaatatttacttcatacagaagttggaaaacattttgaataccgaaactactacgatagctatttcaagccattgatggaacagctaggtattaatcgtacacctcactgctgcagacatacatgcatctcaatgttagcagaagctggtattaaccagacgattatcaaaaagattgcggggcactcaggtgcaatgacactcacagagaaagtgtatacccactttgatataaaggagcttgtagatgcgattaataagatttaaacaaagaaaaggacactccccagtatctctactgaaaaatgtcctatacatatcaatatctttgttgcatacctgctgcatatgtgttgcattcgatgtaaattccagcacatctgacggcattcctcaacttctgtaacccttgaaaaatgggcttttcttgatatcttcgttcttgaaagattatctctttgagaactgcggagcgcgacgagctgctttgagaccgtattgcgcgagtttttgagctgtttttccttgatactccgggcttttccggctttctgcctctcagttatccggtgtgcggaccataaaaaacggccttttttcattcagcaatagcctgatgaaacgcaccatttactaccccaaacagctcctctggtttattgtacttcacttttgcatagatgtccatagttgttttgctgttttcgtgtccggcaaggtattggacggtctttggatcaacaccagcatagagaagattggtaatgtaagtgtgccgtagctgatgcggggttacatcaaagtccagcgtatatctgattttgggttgatttttctgggtcatgcccagcgttggggtaaccgcgtatttgatgctctgcccattcacatacttataatagttccggggcttagtggatcggacaacgacatactgccacactctttgaaactgcgaagcagccagcggctcccctttactgtcagcaatcacataatctgatatggaattttctttcgtttctctcagacaatccaccaaacacttcggtatcggaatatccctttttgccgccggagtctttagcaccgtagaaatcacgggtctgttatgctctgtacgccatgcccgcctcaccgatagataaggtgtatcctcgtccagaaatacacaatcccattgcagtgcaagaatttcttcccgacgcagaccggaatataaaccgagcataataaacaaatatggaggaagccccttgactgtatccagaagcacggctacctgctgatctgtcaatgcctctctcttttttgatggttttccgcccttgcccgatattcccacacagggattgtgttcaagaatttggtttctctctgccgcataaaaaatgcacttgagtagcatattgaccttattgtataagccttccgatttctttgacaatggaacaagcgccagccgaatatcgtcagcggtcacttcttccatatacatctctcccagaggttttatgatatagtttgtcatatccctcgtataacctctgagtgtagacgcagacacctttgccgactgcatcagcagccacttctctccatactcggctactgtcgggtgctgccggtgaaagataatttcttccacctgcttccgggcctctaactgcttctcatacaattcttcacaagttgcggcatacaaactcaactctttgccatctgcatccgtaatcctggttctgtaatactggattcctttcaatgtaatggtcccgtacttcgggatctgtgttttcttttttgccatctttgatcgtcctttcttgataatgtgtagtctccgtatctacactctctttttatcagaaagcctcgatttaatcaaagatacggctgaggtaaaacaaagagcgagacatccttgcctcgctcctgcttcatttcctatttgttattactgtgctgcatcccagcttgcaaacgcacagttcattgatctgaccaactcatttggtctgttgtacttaacctttgcataaatgtccatggtaatcttgctgctttcatggcctgccaggtattgaaccgttttgggatctaccgatgcatgaatgagattggtaatgtaagtatgccgcagctgatggggtgttacttcaaagtccagactgtaaaccacttttccgttatgagcagccttttctcccaagacaggtgtgacagtatgctttactctttttccatcttcataccgataatagctccgctccttgaccgtcctcgtaacaatatactgccaaagtcgcttaaactgcgtgtaggacagcggttcgccatcccggtttgaaaccacgtactccgaagtcgaagtttcctttgctgctttcaaacactcagccaagcaaacaggaagggggatatttctctccgcagccttggttttcaattcatccgaaatcaccggcctgttgtgttctgtatgccatgcccgccttaccgtcagatatggagtatccgtatccagatatactgaatcccattgcagagcaagaatttcttcccggcgcagacccgcatacaaaccgatcatgacaaagacataaggcggcaaatctcggatagcatccaaaagtcgctccacctgttcatctgtcaaagcctgacgctcctcttgaggaacaccgccaccttttgttgtcagataaatcgttgggttatggtcaatgatcctgctttccatcgctgcgcgaaagatagacttgtaaaggatcaccacagatttataaaccgatgcagatttcttggaaaccggaacaagggcaagttgaatatcatccagactaacctctcccatccgtttatctcccaattccgctataatatgccgcctgacctttgaggtgtaatccgtcaaggtagtggctcgtacatgaaccgactgcatcagcagccacttttcacaatactctgcaactgtgggcgttttccgatgaaaagtagcattctcaatctgttccaacgcaagcgtttctttgttatatagttcttcaggtgtttttgcgtagatagctacgagcttaccattcgcgtctttgattctggtcctataatataggacacctcttttcatgactgtgccatattgaggaagtattatttttctatttgccaattcctccacctcctaagaataatctccagcgctgtacctttgttttatcagacctctctgattccatcaaggatacggaccggctcacgatcttccgcttcgaggtttacggtaagttgcgcttctctcaactggttttgctctgtgcgtgcattttgcgatatactcctggagacctgccgcagtaaaatacacacagccattctgaacatactgcacataagagatcaagccgttgttacgggcggcatccagcgttgctatgctgattcctaagatttcagcagcttcttttcgtgtaatgagcttttccatagactatattccctccaatctgtcaaggttatcatcgtgctttcaaaatcacatgaatacgctggcagccgaaactgccagcgcatggtatctgattttgaatagaaagcggccacccaaaagagcagtcgcttcctatttcaatatgactcaattctcgtcacatttgccacgcaaccctgacgatgggaacataacaggtctccgctggcgcggttgtcataactccgcggcgtcgttttactcgtgcgccgcagggttccccccaagtctttggcgggccgtgaggaagtatctttaagcccccatgcagtcatcgcgccgaatctgccacaatccgttttatgaaatcgtagatcgctccgaagcagtcttttcatcacctccctgactgctccatcttcgcggcgcttcatattcgctcgtacatgggttatgtacctgttgtgctgtctattcgattgtcaatgtacgaatgaaggaggaaaacttgtccttcttattaacactgacaaaaaaggcaaaaaacaggcgcatcaaatgaaattttatcaaaaatattttccaagccgctttaatccacggcggatactgtcgcgaacacggcttgggtctacaccttctacttcggcaatttcatttaccgtcattcccaggtagtatcgggcataaatccgctttgcctgtttctctggcagtttcatcacagcggcatagacctgctcctggaactgtttttcctccagaaccatctccggtgtttgcggcttcaacagcaccgcattttcaatgccattctcgcaatccagagaatactgtgatttataacgatacatctttcgctcatacgcagcctccgcacgttcagctgcccgaatagtctctattacttcctctgtcacatctacaaaaaagtctgttgtataaacatcaggataaagttcccgaaggttaattttcttcattatgtacctccatttcgattcacgggtgattaacgggtgaatcgaatggaggcggggaacggcaccggcaaacaaccggatcgtctccgaaaaaatggcaacagaaaacgccagatttccgcgatggaaaactggcgcgccaaaaacaaccactattataccgaattacatagaacgataatgccgatacaatattatacttgcccggaggaggagcaatgctttttttaactgatgtagatcatgtgagctttgaaaaagcaaacgggacacggtaaattaacctccaatcggctaccgtgtccctgcaagtcgtcattggtttgtgcaatcgcaaagaaacggcggctctgaaaatcaaagccgccgtttcaaatgggcgtgtcaaattgtctgctctacgacggctttttttcttttgccgtcgtccggcaggttgtttcttttgcgcttatcttaacaagcaattctcacagaaatgtcactgacattctctgtttcgacagaataatgggttgaaatctcacaagcctgtgagatttgaaaatttattgccttttcttcatcgaatttcttttttccgaaacagggcaattcccaaaacagaagttagaaatgtcaccaacagagaatatcccatccatctgtaaggggcatttgctatgctttcatctgtcattccctctgtgtcaaacgcatctgcaagttggatggcctgtccagagggtagcagatcgctaagaacttcaagaacaatccgtggtgtaccttcaatgtattgagggttcggaagctgttcaacttgtgtagggatacccatttcattgacagtcacatagttatcgtaaagttttggttctccaagtttctgatggataaaagaaccggataccagtagaaccaaagccagtatcatactcacaactacattgcctgccttatttgtattcaggatagcaagcagcgtcataatgctggcgaaggttacagaaatcataagactgcttatcatgcacaaaaaaattgtagctgtttctgttatcagttcaccgccattcatgtttcctattacaaaaactccaacggtataggacagcgaaatcaatacactggcaatcgcacacacaataagatttgctaagtaaatccgtattcgagagtggccgactattatcttattgcgaatggtaccatcgctgtactcggaaccaataaacaggctcgtaaagattgcagatataagccccatcagtggtaaacactcaaaaaggcatccatcaagcacaaatcctatacgagcctccgaagctatatttaatgcactatacactccgtatgcaaacatacaaagcacaaaaaaccaaaatataacttttttcagcatacgaataaatgttgataccaatagtctactcatggctaacacctccgattaaatcaacatagtagctttccagattttcttcctgttcctgaatggacagcagatcacaatggtacttatccagggcagatgtaagctgggaaatatttaacctgtgataaatctctgccacattgggagcaggcattttgtaaggttggcctgtctgcttcaaaacggcggccaacgctttgccatctgttacttcaattcgaatagacttgcggaacgagttttccaaatcatccgcactgatttctttaatcatttttccgttgtcgataaagccgtaatgcgtagcaagacgggacagctcatcgagaatgtggctggataccaaaatggtaataccatactgctgattgaggttcaaaagaagctgccgcatttcaatgatgccctgcgggtcgagtccgttgatcggctcgtctaacaccaaaaaccttggatttcccacaagagcaatcgcaattcctaatcgctgcctcatacctaagctaaaattctttgcctttttcctgccggtatcctccaagcccaccaacttcagaagttgaggaatggtatcgaatgatcgtagtcccaacacacgatactgttcctttaagtttccggtggccgacatatccagatagatagccggtgtttcaatcacggcccccatttcttttcttgcgttcaggatttcgtgttttcggctgctaattccatatagggaataatccccgaaagtagcttcttgcagtccgcaaattatccgaagcaaggttgttttgccagcaccattttttcctactaatccatagatactcccctgcggaatgtgtatggaaaaattgtctaatgctttatggtggccgtaaatcttcgtcaaattctcggctttgagaatataatccaaaatattacccccttttgatgatactcgctgtgtgcgagttcctttgtcttatagccatcataaaatagaaacctcacagaaatgtcaccgccagcccccttttgtcggctaaaaattcacatttttgtgacatttgaaaacggccatcctttcggatgaccgtttcgtgtctgcgtattttattcagcaatgcgtagccgatctaccaccgttttttgtgccattttgttatagcaaaccaaaggaacaatggctgtaatgaggatcagagggataatacagagaaataccggaagcagagtaaaatgccatgtaaaataggttaattctgcacccatcatccgcaccaccgttagacttgctataacggaaagtatcagagaaccgaaaaggcccaagatagaataaccaatcccttcatatatcaacatttgcttaacctgtcgtcctgtcatacctaccgattgcagcattgcaatttctctgtaccgagacaagatagacgttgtcatggagttaataaagttcaatatgccgatcagagccaatatcgcacaaagagcaccgcccacaagacggtacatattgatcatcccgtcaaaggtctgccgcagggtcacttttgaaagataatccaaagcagtgtccgtattcgtagtgtaatttttcagccagttttctgtggcaagctggtgttcttcatccacattgaagattgttttcatggccggctggtcggcggataccatattttccaaaagttcattggttgggaaaatatagtctaatcccatgtctacctgcaaaggagtttgtaatgcgcttggaatacttaccacagccagcacatcatacactttatttgtaccatcaagctgtgtcacgctaatttgatcgcccggtttatacaagtaaagagaaccatcacccatcattcgcaacggagttacatacacgccggttccggctttccactgttccgtgtttagttcaccgtctaacacctgtacatattctgccggaaaatcatccaagccatatacattcacaccatgttcctgtcgaaccctataattttccagttcatttgcaatatcaccggaagaagcagagagttcctgtaatcgggcgaggtcgttttcagaaagcggctgtttggaagtccataagtagatatttcctatatcttcaagaccattcaaactttctgcctggctaataaaatcttggcttacactcgctgtgttatatggcgcataattgttaattactgttgtatcggaaactgtaaaatctgtaaggctgaaatcagccacaaacttatcaaagtcaaaggaggtcacataggtataaacgctattcaagagaacaatactaagggcaaaagacaaagtaacaatcattacttttttcttgtttcgagtcagattgttctttgccatcatcattgtgctgatatgcttactgcgccgctgctttttctttccaccagtctgttcaatatagtgcagtgcctccatcggagaaactttagccgccaatatcgcaggtttttgacagctaatgaaaactgtaattgcagaaaagacaatcgctaccaaaaagatcaatggatttatcgtagtaacgatccttatatcatcagttagcatatttacaatcgcaggcagcaacaaccgaccaatcggccatcccaacaatagtccaataggaatacccataagagatagcttaattgcttttctataaacgattttccttatttgtcttgcggtggttcccagtgttttcaacattccataaaaccgaatatcctgtgcgatagaaatataaaacacattgtagattagaagataacctgcaataaagataaccgcaataccggccacaagaggcagcatggaagaaagattgaccgttgccattccgtaagcgtcgttaatacttacccgttcatctaaaccatattcagaagtcacatctaatgcctgcttttcaatattccatgccgtaggcatcatcataacagtatcaatataaccggttcccacaggtggggttgttccgtccgtttccccgtggatgaccggagctacctgttccgtatatgctttggataatagcattgtttgacggtacgccacagcatccccatcccaaatgccgcaaagcgtaaaggtatcggtaaatgtatccgtatcggttgtaaaggtcaactccatttgtgtgccgactttatccggcagtcccatcgcatccagaacaatacgactggtggcaatctcatttttttgttccggcagatgtccggtatcaggagtattaaaggtcagttccgaataagtttcatcaccatatcgcagttccgtcggcgtcttattgaaatcatcgcccacggcatttcctatgataattgaatatccgatgtcttttattcctgtatccgatgatagcttctcatattcttcccaggataaacgcttgataccagcatgggcagaagtgccggttgtcctcatattactttcctgcatggcagtctgcaagctaatggcaatcgtaaacaaactggtaaaaagcaacgtagcaagcatgattgccaataccgcaatcgtatttttttgagctttcaacgagcgctttgccagaagtttcaagacaggtctgttgttattcccaaataaaatatctgtcatgttttcgccccctttactcggaaatccggccgtcctcaatacgaataatgcggtcggcaagctgggcgatctcattgttatgagtaatcatcacaatggtctgatgaaatttctggctggtcattttcaaaagacccaatacatcgctgctggttctgctgtcaagatttccagtaggttcgtcggccaggatgatagccggtttagaaacaagggcgcgggcaatcgctacacgctgctgctgaccaccggacagattgttaggcatactgttcagcttttcatcgagagccagcattttcacgacttcattcatgaaatgcttatcaacggtatcaccatccagctccaccggcaaaacaatattttcatagacgttcagcacaggaacaagattgtaattctgaaagataaaaccgatgttgcgtctgcggaagatggtaagctgttcatccttgaatttcgacaattcttttccttttactttgatactgccggaagttggagtatccaatcctcccatcatattcagaagtgtggattttccactgccagaagtaccaacaatagccacaaactccccatcctcaatggagagggttacgccatccagtgctttcgtaatattgggctttgaaccataatatttttttagttcagtcgtttgcaaaatgctcataaagaacaccatcctttctttcgttaagcccattgtaacgaccaaacctcacaggaatgtcacgagctataaattatttttggacaattcggttctaaatgtcataagcctgtgacatttattcttcggcgtacttactctgttctcgaagcaggaaaacagaaaaggttgaccccttcccaacctcggatgttacccgaatataaccgccttgcaaggttacgatctcacgagccagatacagaccaataccaattccatctacatcatgtacgatgtcctcccgatagaaccgcttgaaaattgccccctgatgctgttctgagatgccaatgcctgtatcagtaatgtcaattttcacatacatttcccaactttcaaccgaaacccggatttgaccgccctccggcgtatatttcaccgcattatccaaaatgttgaacagcgcttcacctgtccattttctgtcatgagaaacgatcaagctctccgggcagtccacttgaacattgatctgttttttctcggcgttcagaaggatacctcccaatgcggcggcaagcgtgtcataaagcggctggcttttcttttccagagaaatgacacctgtttccagacgcgaggttttaatcatagcctgcatgagaaaatccagtttatcaagttgggtggcctgtgctgtaagaaactctttttgcttttgcacagggatttcattttcaagcagggtgctgttaatcactttcaagttcgcaatcggggtcttgacctgatgagaaatatcggaaataagttcttgcaagtcagcccgctcttgtgcaatgctgttcttgttttcctgcatgatttcatacaaacggttcaaccgatattcaattttatagaaaagactttcttcttccacagtctgtttcggctgcatattcccggacaacatatcatccatcaaactgcaaaaagcatcggagaacatcgccaatttgcggcgaaccagcaccataaaacaaatagagcaaaacagcacaaagatgccgaacaatagtacataccaaacagcggttataccttgggtcaacgcatataaagccactgaaaccgtcaccattgccgccagcaggagaacagctaaaaagatacaggctttgttgacggaaagttttcgcacattcatttcagcgcccctccgatccacatatagcccataccatataccgttttgatgtactgacggtcgggtgtttcgattttgtttcgtacccggctgatagccgcagtcagagcgtgttcatccacaaaatttccgtctgcgtcccacagtttttccaacaagacttgccgcgtcaaaacgatctgtggatttttcatcaggattttcaaaagtcgatattccagtggggtgaatgtaagtggctttcctgacagggcagcactcatctctgaaaaattgatggtcagtgtgccatcctcataagtatcaccaccatattgttttgtcagccgccccagcaccaccgccagtttcttttgaaagacgctcatagggaaaggttttgtcacataatcctctgcgcccagttcataccctttgagcatatcgctttccatatcatttgcggtcagaaagataatagcggtatcggggcggcgctcttttacctcccggcagaagtcaaaaccgttcccgtccggcaaatttacatccagcacaatcaggtcatagtcctgcttcgtcaagaaactaccggccgctgattttgtcagtgcagaatcaaccgcatagcccgcagtattcaagttatagcataaagcattattcaaaagtcgatcatcctcgactactaaaattcgcatggtatcacactccttcattttcagtgtatcacccaaatgtcacagaaacctcactgagatttgttttcttttctccgcctgtctactggcttctctgcatttttaggaataagccaaatcgtcgccatttttacagcaccggggatgcgcccagatgtacacaaataatttatctggcgcggcgtaacattccatttttggcttgcctcttttaatgttatatagtccattttgcacctcctaaaatattatatttcgtcttctcgaagaatacaagtttatccctacctattactctacaaaaatcagcataatcttaccgttcatcaggcataattaggttattcctttgcacaaaccagaacgatacaatgttattgaggtgaacgattatgccgattgatgatttaactgctttagggcagaaaatgcgggaagcccgaaagaataaagagctaacacaacaggagctatctgatttgagccatgtttctgtaaagcaaatcgccaatatcgaaaaggggaaaatgaatccttcttatttgattttgagagcattggccaaggtcctgcatatctctttagatacacttataaatccagatgtttctctggaggatgaaggtgtcaatcagatgaaaatgctttattccagctgtccgccagaaatgcgtgacaccctgctgcatcacacccaggaaacggtgaaagaactgacagagttgtcaaaaaaatttgaaacgaattgagccagtgagtgaaatttaacgattctctcactggttcttttcattttcggagaaaagaggcaagcaatgcctgtgttaatacacacaggcccgcagagaagaaaatccctccgtgattttcctctccgcttgcttgttgagggcagcgcccccaagcccctttgaacacagaatttcattctgtggctgcgcgttctgcgaacgcttttgaccaggaccagcttaccgctggccgtggtctttttctttttcaacatcctgttctacctccattttcagcactcgatctacattcgcttttgcagtcaaaagctccctcatttcttcacgggagcgccgatactcggaataagtctttttcttttcttccagcaattttgcgtactctgtctgtaactctttgacctttggcagcttcttgacgcccatctcatcaaaggcattcttagcagcctggtggagcagaatttcttcctcatgttcctcccggaatttcttagagtagcccgccttgcggtatgccacatagacctcacgggtcttggcataatttacgatgtgagtacgcagaacagcaatctctgccatgcgcttttcagccgctttgatgtgcgccgaaagttcattgtgatgtgccgtggcagccgcagccttttcttccaaaaccgcatactccagcaggttattctctgacaggtaattcatggtctgcgccatttgcttcagattgaaaactttagcccatcgcgcatagccagcaccttttccagcctgcaattttgcctgaatgtccaccagcagattgacctttggcggctctgcctgtgtgactgttttctttcgcggggtatgtgctttcttcccggagagaactgcccgcaaatcttccaatccatatccttcgcccagactgtccatacgggcggctttctcccaaccagagagcttcagtcgatacgattttccgcgctttgaaacttcacaaccatactcttgcaacagcttcagcagttcttcaaagtcagcaggactttgtgataatgcgttgtcaatcgccacacgaagcagctctcggtgagagggctttgcctgatcgcccagccatttgttatagctctttccgtgaggtttcggattctctacaatggacagtccattctcaatacagatggtgtcacttagccgacgaaccgccttggtgctgccccaaaagtttcggaacttccggtcatattctaagctgaccgatgaccagataatgtgattatgaatgtgcgacttgtctatgtgagtgcagaccacaaaggcatgattgcctttagtaaaacgctttgcaaattctacgcccagccggtttgcttcttcctgggtaatctcaccagggcggaaggactggcgcacatgataggcaatcacatcatctgtaccacgcactcgtccggtagcggcaatgtactgccgctttgccagaaggaactccgcatccgcagtccggctgtcacacgcatagccggtaatgagcctgccgttatctgttttctttggattggccacatagtcgatgatgtcactgattgcccgactctctgtgcggcctttgccgacatgaagcggcatgattcttgtagttgccataataggaggtcctcctctcataaatatttttgttttcgctgaactctttgcttctatcgttgcaataactttctccgctgggtataataaaaaagaatattctacaacctcaaaggagggatttctatgatagaacagctcattgctgaagcaaccgaatgtgatttcaaagttgctctcgaaacaaaaaagccaaaaagctggttaaaaagtgtcagtgccttttccaatggaatcggcggcactctgtttttcggagtctccgatgaccgggagcctatcggcttgtccgatgttcaaaaggatgctgaagcgatcagccgcttaatcaaagaacgtatcacaccattacctcagtttatcttaaaaccattacaggaagatggtaaaaatctattagctctggaggtttctcccggccgcagcaccccatattattacaaggcagacggagtgatggaagcatatatccgtgttggaaatgaaagcgtaattgccccggattacattgtaaatgaactgatcttaaagggaaccaatcagtcctttgacaccttaacaacagaagctgtgaaaaaggattacagcttcacactcctggaggcaacctatctggaacgaaccggcctccgctttgagccatccgattatgtttccttcggtttggctgacaaaaatggggtcttgaccaatgccggaaagctcatgaccgatcagcacacagtttataactcccgtatgttctgtacccggtggaatggcttggaaaaaggctctatctttgatgatgcactggacgataaagaatacgaagggaatctgatttatctactgaaaagcggcagtgaatttattcgcaataattccaaagtccgttttgtcaaagaggcacagtatcgtgtagacaagccagattatgctgaacgagctgtgacagaggctcttgttaatgcgcttatccatcgtgattatattgtacttggcagcgaaatccatattgatatgtttgatgatcgggtggaaatcacatctccgggcggtatgtttggcggcggctcaattcaggaatacgatatttacagtatccgttcgatgcgacgaaaccctgtgattgctgacctgttccaccgcatgaagtacatggaacgccgtggaagtggcctacgcaaaatcgtcagtgaaaccgaaaagctgcctggatacacagaggcatataagcccgaattttcctcaacagcgacagatttcagagtcatcttgaaaaatgtaaactacaacttagagggtgacgcccaccaagttatccaccaagttacccaccaagttattgaactatcaacggtatccaaacagattttggctttttgcacaacaccaaaatccaagaaagagcttgcagtattttgcggcttcaaagatttaagaaacttcaccttgaagcatatcaatccgcttttagaatccgggcaattagaaatgactattcccgataaacctaaaagtcgcaatcaaaaatatattacagttcgttccgaataaacagagaagcagggcattgggtctcatctcccattgtcctgcttctttttcattccaaattatattcacatcatttacccatacacccaatcctggatcgcaaatttcaaactctgcacctttcccagcagccagatcgcagccagcggcagccccatcgggctaatcaaaaatgccataatcagcaaaattgcaccattctgcggggaataggtaataagcacagccacgccaagtagagcaattaccgtgctgagcagaccaagcaccagaccagatatgtagatcagccccatgcagagccagacaaaaagcgtcaacactaaaatgaccggtgcagttacaatcatcagcaagcatttcaaaatcttcattccagttcctccctccaacgttccagataccgtttgcacagggcatccgcttctctctcatcatcttccgtcaactcccgtctgcctttggtcagttcaatctccacataagtccggtaatcatcagctaagagattgaatagttccttgggagtatggcacacctcgccagagcaatagtgaaaatcttggtcaaattcaactcttacacatccatggcggctgatataaacttctatggtctcgtctgcggtcaggtaatccgcaaaaatctccagcaccttttcaaaggccagcatctgttttcactcctttgctacgcttcttattctactcatattatccggtacggacaggcaaaagacaaggatacagacaaaaagaaaaagcggaggaaggtgcggcgaagaaacgccgttcctccctccgcaaatggagtatctatccctgttatgaaagtttggagagttgggtaaggatttccttcacaccctcccacagttgttcctgccgctgggatatatcctccaagtcagcattataaacccgcccggtctcatgcactttgcgggtcagctggttcaagttgttgctgcttcggcgcatcagggagaccaactccttcagctctggcagttccagcttgaccacataaccatccagcgccattttccgcagataagcgctcaaattctctgtcccgtattgctgcatcttttgatggatcagttccagttcttctgcggacacccaaaacagaaccggcacatcccgcttgcgctttgccatggttatcgctccagctcccgttttttcggggcggcagacttattggcgggcagctcctgtttgagcttatcccgtactgagggacgggacggttccagtttttctctctgggtacggctgcgctgctgttcttcacgcaccagatcaataaaaccatccagcacagcagggtggctgtttaaggcataaccacaacggacggtttcgggattatcattaggaatggtcttggcccattctttgttgcgtcgggagtagcgcccatcccagtcctgaagctggatcgtgttagacagaaccatagatacacgctccatgccataggtctcgatcacaccctttgccgcatcgtggctgagatacattccgtcgaagtgttcccgcaccgccgcttcaatggactccttgcattggagatttacattgttggaagctcggtactgctccagctccccatgttctctcgcataggcagctgaatggggatagattggtgttgttcgcagttcctctttagctctgcacacatcgtcggcacggttctcaatgctgtcccggatcatatccatatagccggtctccagcttttcaaaataacggtacacatccgccagcggcgagggagattccaaaagtgcctgagcctgggtgtcggtcagctccagctcctccattgccatcacgatgtcctcgcggatggtgtactcataggcatggtttaagacttcttccgggggctggcttttcagccagtcccggaacttgtcctgttcggcagtcatcttttcaaaaagggccgtattcagattattggtattcatgttatcgcacctcctcatgctgttttggtttcttgtctgtactgcggggcgtcgccggacgcttcaggctgtccagcaccgagggccgcgcactcttggcaaccacagtttccggctgggcatgaccctttccgtcgatgttgagcaaagtatccagctccaccagacgggcatttttgcttcgcagttcttcttcataaaggaatggctttccgacttcctcctttgcggcagcctgctgctgatagaggttatccagctgggcctttgccgcctccagacgctggggcatctgggcgagggcattgtcgatacgggtaagatttccgcgagggtctataccaagggttgcccggtgggtcatctgtcctttcagcaggagcgtatactcctgtttccatgcggaaaattccacggatatggcatagccccggtagctgccgatctgcaccggatcggaggttttgacctccttgcaggcatccaaaagggctgcgccggcgttctccttatcggtcagcagatcgccacggatttccataccagcaaaaccgtcctccgggtgcgggtgcgctgccaaaacctccagatcggattcaaagcccttgataaagcctttgtgcttttcaatctcctccgggaagtatttgagcagctggtcctccagacgatattgcttgctctggtggtcggctttcatcagcttcaggcgggatacctccacatccaaatccatgcgctctttgatacgtgggtctccggcacacaaagccttgatctctgcaaaactgagggcggtttcatccacatcatcgcaggagcgtaccggcgatttagaagtcatgatctgactaatgaatttttgcttattctccaccgtctgccagaggtatgcgtcaaaggttccttcggtcacatagcggtacacatggacaagaggattctggttaccctggcgctcgatacggcccttgcgctgggcaaggtctcccggtctccacggacagtccaggtcatgaagtgccaccagacggtcctgcacattggtgcctgcgcccatcttggcggtgctgcccaaaaggacacgcacctgaccggtacggactttagagaacaactcctttttccgcacttcggtgttggcttcatggataaaagcgatctggtcggcaggcatcccctgagcaatgagtttctgacgaatatcgtcatataccgtaaaggccggttcctgctccggcagaggcacagcgccttccaatgcgtgaagcagtggattatccaacgttttcgccgccttgcttgcaggagcttttgcctgcggtgtagaaatgtcgcagaacaccagctgggtcagcttgtcagctttgccgtcccgccagatctgcatgatgttgtccacgcactgattgacctttgtgccaggttcatccggcagcatctggttgacgattctctggtccaggcccagcttacggccatccgaggtaatcttgagcatattgtcctgggacgggtcaacggttccgctgtgtaccagcgatgcgcgctccgaaagggtcttgaccatttcctgctgatgttcggtaggctgcgccacgatgttgtggtattccacctccggggtaggcagattcaactgatcggcagtcttaatgtcggccacttctttgaacaggttcatcagctccggcaggttaaagaacttgctgaatctcgttcttgcccggtagccggtgccttccggtgccagctccaatgctgtgacggtctctccaaatcgggaagcccagcagtcgaagtgggtcatgttcagttcttgcaggcgttcatactgaagataacgctgcatggtgtaaagctcggtcatggagttgctgaccggggtgccggtggcaaaaatcacgccacggtttccggtgatctcatccatatagcggcacttggcaaacatatcggaggatttctgcgcgtccgatgtggaaagaccagccacattccgcatttttgtgtatagaaacaggtttttatagttgtgggcctcgtccacaaacaaacggtccacacccagctgctcgaaggttaccacatcgtcttttcgcccctcggcttgcagcttttccagtctggcttccagagactttctggtacgctccagctgtttgacggtgaaacgctcgccgccactggcctgtacctctgcaatcccctcagtgatctcgtcgatctgttcatagagaagccgttcctgacgctcccggctgatggggatacgctcaaactggctgtgtcccatgataatggcatcataatcacccgtcgcaatacgagcgcagaacttctttcggttatgggtttcaaagtccttttttgtggtgactaagatattggcggaaggatagagacgcagaaactccgacgcccactgctcggtcagatggtttggaaccacaaagagagatttctggcacaagcccaggcgtttggcttccatcgaagcagctaccatctcaaaagttttgcctgcgcctacttcatgtgccaacagggtatttcctccatacagcacatgggcaatggcgcttttctggtgttcccgcagggtaatggccgggttcatgcccccaaaagtgatatggctgccatcatattcgcggggacgggtagagttcatttcttcgttgtactggcgcaccaaagtctggcggcgctccgggtctctccagatccagtccctaaaggcttcccggatcgcctgctgtttttgagccgccagggtggtctccttggcgttcagtacgcggcgctcttttccgtctgcgtcctctatggtgtcatagatacggacatcccgcaggttcaggctgtcctccaaaatcttgtaggcattggcacggctggttccgtaggtggtataagctgccacatcgttgtaggatacagaagatttccccttgatctgccattcagcggtaaaggacgaatagttgaccccgatacttcgctggagataaaacggggtattaaaggtctcatacataaactgctggatatattccttgtcaatccaggtagcgcccagacgcacctcgatctccgacgcatccaggtctttgggctgggcggcggtaagggcttccacattgactgcataaaccgggtcctgctgtgcggcccgctgcgcctgacgcagtttgcggcgtacattgccggagaggtattcatcagcagtcacataatggggtgtgccgtctttctccagctgtcccggtacacggaagattacgccttgcagctctccggccagttcttcttttgtttttccggtaagctggctcatatagcccatatccacgcaggctttttccgagatggacaccgccagtgcttcacttgccgtatccaccacagccaccgcctgatggggcttgatggtccgcttggtgaacatatctgccttgcgttccagctttccgtcctcgtcgatgacttccaacgcacagagcaggtaataggaagaatcgtctgcataggccagacggtttgcacggtcattgatgagaccgtatttggaagaaaagctgtcatagaggctgttcagttccgcctgcttctcccgaatggtgctgtccggaaccgctgcatccatctgaaggtcgatcagttcctgcacacaatcacgcagtcccacaagaccttttacacgggcttcggcggtggcgttgaggtcagggcgcaccatacggctgttttcccggtagtacacctgcccgtctacaatggcataggaatagttcttcacattggggtcggcaggaatggaggtgtcaatagcttcgccttcgcccagctccggcagctctgcctcctgataagtgccatgaatatacttcaccgcatcatgcagctggtcggaaagctccagtccctcgatagggttcacggtgtagtccataccatgagcagtgcttaccggctcctgtctgcccagcaccatttccgagtggtcgataaaataccggttgatggcaaatccgtcctccgtctgtccggtttgagtccattccggcacgatgtccagcgggcggtcccgtttttggaggaagatgatgtccgatacaacctcggcaccggcattctttttgaacgcgtcattaggcagacggatagctcccagcatctcggcacgctgggcaagatagcggcgcacggtggaatccttggcgtccatagtatatcgggaggttacaaaagccaccacgccgccgggacgcacctggtccagtgctttggcgaaaaagtagttgtgaatactgaaattcagcttgttgtaggctttgtcattgacctgatactgaccgaaaggtacattgccgatggcaaggtcaaagaagtcacgcctatcggtggtctcaaagccacctactgtgatgtccgccttgggatagagctgctttgcgatgcgcccggaaacagggtccagctccacgccgtacagacggctgtttcgcattttctccggcagcataccaaagaaattgcccacacccatagacggctccagaatatttccggtctcaaatcccatacggtccaccgcttcatagatggcctgaatgaccgtagggctggtgtaatgggcgttgagggtagagcttctggcggcggcatattcctccggggtcagcagttcttttagctgggcatactctaaagcccatgccggtttctccgggtcaaacgcatcagagagaccgccccagcccacatatcgagaaagaacctcctgctgttcggggcttgcctgctgtccggcagcttccagctctttcagcaaacgaatcgcattgacatttgcctggaacttggctttcggaccgccctcacccaaatgctcatctgtaatgcggaagttttttgcattgcggcgcaggttagccttgtattcctcataagatgcttcctcggcagctttggcattgggaaaggtctgccactggccattgacctgaatggaaaccgggtgttcatccaacacttcctcaaaggttttctccggctcagtcacaggggctggtggctccggctcctcgatatgcagtcgttccaccaccacatcataaggcagattgttcttatcgcccggatagacggccatggtctcggaatggaaggtcggggattcggtagctggttgggactgttcctgtccaaaaccgtcctgctgacgggcatacatcccgcgcagcaaaggcgcaacctcatcccagcggaaatacagcatagccagacgcctttcctctgcatccatgacttccagttctatgccctgtgccgtggtacggtaatcggcaatatcgccggtctccagattcagtgtctcaatctcaccggaataggctctgctcagccagtaggcgatctcgctgttgctcctgccggattgcagcagcgtggaaatctgctttttatccgcttcatccatcagtccatgagccaatacatcccgcaagtcctgatctgccttgtccgggtcagtaggaagaaactcggtatagtaagcattgcggcggtctgcccgaagcagctgctcgaactgttctttgcgctctgcccggtagatgggatataccatcccggtgggcagaagctgtacggtgtcctcccgcagctcggtgatctgataggcgtcatcctcgatatacacggtatcgcccacggcatagaccggggcagcagggtcataggatgttctttgcggagttgggcggcgaactgcatcatattcctcatcggaaatagcaacttcggaagtctgctttgtctcagcagctgcgatctgctctacatccgacatcacctgttggataaacgaatcattgtccagtttttccgggtctgccacctggccgttgacgatccctctttcctccagagcttcccggatggcgattgggtcgatgtcgtcaaaacggtcctgttcttcttcggtataaaaccgttcctcctgaatgagctgggcaagcctacgctgtaccttcggccagggcagctgcgtttcctccgggctgccggcacggacaacgaacaggctgttgctgttactgccgcggtattcctgagccagccatgcggcggtatctttttctcttgcatggtctttcatatagcggacaacagcgtgtttactctcgatattgccgttccatgcacaaagggcagtatcaatatcttcctgagaaagagggcgcagaagctcatggagctttggataggtctcgtcgatcacttcccggtgtaaacgctggcggaactccggcacatccgaatagagtcggatcagctccatatccttagaaccaaggactgcacggcgcacagcggcattaccctcgatgacagcattttcacggtcagaatgaccgcaggcattgcgatatgcggtatcctcggaaatggcgacagtcaccacaggcttatactgctcaaactgctccccaagggtaggctttggcgtttcttcctccatctccggctgctggacttgaatggcatcttcttcggccagttcctgttcagactggatcttgtcatactgtgcctgttcctgttcggtaagatagcgttctttctggacaagtgaggtaatgcgcttggcaaccttttcccagttcaagtgaacatccgggcagtcctgctttttatagtgcagtcctttcccatcgtgatcttcgccgctgtgtgttgcgccggacagggcatgagagcgtccgccaatgccatactcgtctttgaggaatctcactttctccttatccgtatggtttgccatgaagaacgcatagatacggccttttcctccggcgaaactgcttccgccggtcatggcggcgtcgatctcatcctcggtaataaagtgctggacggttggcacttgggaaagctctgaagaaaaggtcctgcgtggaaggtcaaggtccttcaggttctcccagatttcccttggcctatggtagtgaaagcgcaacagatcacggtcctgctgataggcagtcaagaaggcagcgtattcttccttgagggtctggcggaaagccggttcactcagctgctccatcaggcggcgggtctcctccgggaaaccattgcctttgatttctgacaggcaggacaaatatccggcttctctggcttcctcgctgaaatcgtggtacagataccagagcttttctgaaagaagggagcgttcatagcctgccgcttctgcaagctccacattggaggcaaactggccgctctccaaaagctccccgatacgctctgcggcgctctcccaggaaatgacctgggcagacctgtcataacggacagacttcccatgtgaaagatggataccatcctcggcataccatgcgctcacactgccaaggccattgccgccgtggtacagcgttttcagtatctcggcaatctcagcggtggttttctgcttttcaaaggctgcaaccacacgctccctttgacggtctgtattgccgcccaaacgcagcacatggtcgatgtcattttgggcaaaagaaaaagcagaggatgtatgcgctacattctctgcttcatctatggattggatctgttccgcttcggagaggaacaggtttagggtcagctgttgataagctccgccatcaggatctcctcggcctgagctttgcaggtgttcatcagccccacccacttcatgggatcgctggctttcagttcctcggtggctcccgcttccttcgccagctggggcatcatctgctccagtctgctctgggcggtctcgtcgatctccagaaggtgcgggtacagcttttcgctcagcaacatctggttgtagaggatgggacgatgttccttcaggtaggttttcctcatcctgccgtacttgcccaggggtttctccggctgctggctcaacttcaggtcgggaatcagatagtctccgttctggatataggtcatgggattgttcatcttgtttgctcctttcttggttggcttcgcgctctgcatttcggacggtaacgccgatctgccgcagcacctgctggttgatctggctgaccgctgttcccagcgccccgatggtggacggggtattgaaatcaaagattgccatgaaatcttcgtggtcgaagtagcgttccggctccagtccgcagcgggacatcaaagcgtaagtgatgctgacggtggctgctgccttgaactgtactccgatgttaaactcatcatattcctccaaaaaggaaccgtcaacgatatagaagaagtcctgctgatgctccgtccagtattcctcagccagttttccggctacctcggtgagctgtccggcaaggtcatcaccggaaacatcataggtgcgctcaagcatggcctgcaccgaatccaaatggcgctcctccagctgccacagccagggagtgcgggaatgttcacgagttccggtgtcggaaatatcaaaaacatagcgcaggcggggtctgtccccggaatcgtccaccagagcgattcccttggagccgcgccttacataccggcccatcttttcattccacaaatcgtactctgcacaggcggtagcgtccgggcgctgggcgtagatcatcaactgctcatggaatgggtacttgtaaaggcgggaagcagtagtgagaaaccctgcccattcctgccagctccccgtgagctgcgttgtcaccttctccgccatctgtgcatatagttcagctttggttggcatagtgttctgtcctcctttcggtttttgggtaaaagaaaagcaggaaacctaaaagatttcctactaagtaaaactgtgagtattaaattattattggttatacaaactgcaagttatttttctttatagatcagttgtcatttcacacataatgatacctccgtcaaattcaaataatcacgtgctttcagattcaacagaagcctatgatttgatttccagaaaaaccgcaaatctgcgaaagaaccttatgtgaacgtcatatacatccgtcagcatgttaaccatccgagcatgtgaatgtataacctttttcaatcattcgcttctcatgttcagtataccattttttcgcataccattcagccttgtcttcacccggaacgaagactttagtgtacccgtctttatctcccacaatggatgaagcaaatgccgtttctggacagcctgtgatgttcccagcgtcatacttcaaaattatgttctccgcgattgagtagtaaaagacactggcatcagatttatacagaccatcctttgaaagaggatagttcttaaatcgtatttggttatactttggattcatgccatgaacgagagccttttctgcatcaaggtttatctggttaggtgttacatcaaaatccccagtgagtgctttcatccagtcattctctgaactgaatcccgtgagcatcgtacacatataggaatcgatggtaaatggcatcaatataagttcttcacttttatcaaagctgggtgatattactttctcttctataagcatatcctgtagggcgtgatgtgccttaaacctctgtgtcagattctccccgacacactctcctacataaagaacctcataggtaattgctggggtaaaatcgctttgcatgaaaatttggaaccagtcattactacaataataaatcagttcatcaaaagtaaatccaatagtggaaacagcttcacctttatcattaaaagcgaacagccatactttctgcgctttctccaagccctctggttccgtttttattcctgcaaagccgttcaaagagtattttgaatttgtcgatgcggggatgaagatacggaaggatgttttacccacctcagcgtcaaggattaagcaagattcatctgacatttcccttcgtggaacgaaaactggcacttctcgtttgcctatgatatagagggaagcattgtcgaggctttctttctcattccagagttcaggatcgagtacaggtgctttctttatacggttgaaatctttgatagagataggcgcgtgagttaagtgtaaatttgtttctaatatattgttcatattttgttccccctcaaacttgaagttgtctatttctttaatatagcaacaatcataaatatttacttgcttcccgaatactcaatttatccattttatccttgtaagtctcaacgaaattccttacccaatcaggattggtctttgaatagtccctcaaactccaaccgattgctttattgataaaaaattcagaactgccaaaattgtttaccaatattttctcaagcaactgtgtgtttgttttatcttttctgcacagctgatggtcaatagcaattcttcgcacccaaaaatcatcatctgttgaccattcaagcattaagttgtttattctctcgtcaaaaaatgctatatttccaacaattctgtccagcccatctattgtatcccaccattgatttgttttaatatacttttttatgtgtggaacatcatcatatgttaagaattcctgcatcgctacaagataatccatcacaaaataatggaattccctatgttcgtctgcataacatctgtcaagcaaatcccagtcaacaaccttttttgttttttcggctcttagaaattccttatagatggattttcgtttcggtgttggtaaaccataaaatacaaacagatttctcatatatgctgccatttttgtggcgttttcatcatttctatttgcttcaaatttctcttttagttcattatatttgtccatctctgcttctccaaattctgatttgttgcttacattatagctcattcatccctccaaatatagtaggagtttgtaaagagttgagagaaaccgccttcccatcgaacagtttctctcactatgtcatcccgacacgataaatttactggtcaaagtccgggtacaattccaattccgcaaattcatcatccgtcatggtttggagcttgcaaagggcgctgtcggtcagctccctcagttccgtttcctctggcgaaagctcgccgcgcatctcacgcaggctgtcgatcaatccggtgcggctaccggtattgtaaatgcacatcaggttcatttcctcaaaagtgaagtttcccatatcaaatctccctttccgcactctttttgggcgctgtctttttgtgttctgccttgggctggcttttcagctgctccatgacggactttttcttttccccttcctcccgatgggcagcggcagccaaatccatgagggaaatggactgaccgctgcgggcctgctgttccagctctgccaccgtaggctcttttgcgccattgttgatgataccgtcgatcatgccgtaatcgtcctccacggccatctccgcatttttcagcggattttccggcaggaatccggggatctgggtaaaaccaacactgtcacagtaatgacaggataccttaccctcctgcttgatcgcaacgatgtcactgacactcatagaaggactgtgaaaatccgccggtttttgcagattaaactgctcatatagtttttccagctgctccggtaccgtgccagactccctcagcggagcagtgtaaatgagatcataattgctacggtctatggaaatgtcatgggactttagccagtccagattcataaagcgcacattctgcggatcgtcacggctcacctgatagatggcaaagcaatctctgttctgagcaagaaatgcctgttcccgttcctgctgatgttcctggcgctccatgaccttttcgtggaactgagggcttttctcccattcctcacggtccacaccgaaaatgccgccatgatccatgatctcctgtgggtcaaacaccatgctctccgtattgtcctcatgcagcacatagacagtcaaaccagcggcatccagttccagcgcccgttctctggtgacagggagcatcccatcatagaagtagccgtattcctgcatatccggtgtggatacctgctcatcaggcatagggtattcatccagcgcctgctcttgtgcttccggcagctgagaagaagcagccatctgactggcctctgcctgcatctgctggtaggcagcttcctgcaaggtctcaatcatggacaacggtgcgtattttaccgagtctctgcccaaatcgttgtcatcacaaatctggagaactgccttcatgcgggaaatctccggcatatccagctgaccaccatccaactctttcatggacgcggcatcgtaaagggtatagtcccagccgctgtcacaggactggatatgaagataggtggcatcgtcaatcagaaacaaagcctcctgctggttggcatccgcccccagcacttccatttccggcattgccgcagccagttcctttaccgctttttgcaccagaggattatcacggtaatagtcgattgcctggatggtgtccaggtcaatggtctggccggtcaaaatcggaaaaggtccttcatagtcgcttccgtctttcagctcaaaaccaatgcccttgatcccgttcattcgctctactggaatctcctgataaatgcggacagcttcctccaaagacaggttatcgtggtattctccgaggtttggaaattccatgcactctgctacatagtaggtcagatcgccggtcggcagcctatcagataccttaatggcatctgctggctgctctatcggggcggtttccggctctacctttgcatgagggtcgattccgcgctctttgcagatttccttatagtggcgctcaatgtcggagatcaaagtgccggaggttttgttgatggtctccaaactggctctcaactctttcagttccttgccctgactccaactggcaatatagccaaagctattttctccagtctcgatgccaaaatatttgcagactgcataggagatgctttcagcctccacttcttccgtgtgacggtttttgattgcctgtttttctgcggttgcatcttcctcaactgcaagacgccattcaaactgattttcgtccacataacgccaatccatatcagaagcaaactgttcggcttctttttctgtggcaaaatccaacttgaaatcatgtttggttccaccttcactctcctgcacaaccttccatgacggtagcatttcatattttttagggtcatggagcttgctgtgggcaatctcatgaaccgtggccgaaactgtctgcacctcactcatgccctgacgaatggcaattttctgatgatcagcagaaaaatagccgtccgtatcagcagccattgcttcaaaagtaatcggcaccggtgcgttgcggcgcagggcctccatgaatgcctcataatttggcacattgccggaaagggatgatgcaagctccggcaaaggtttcccgtcggtctgactcacatcaaagaccttgacagggcggaacatgggaatctcgatttctttttcctctgtgacgatctttccgtctttatccagaatcggagccttggtatctgggtccagcttctgctcctcgattttcttcttatacggtgtgggagcgatgatggtaatgccatgctcgcccttttttacatgacgctcaaactggtctttccacttattgtatccggctaccaatgtggcgtccggcttctgcatatagatgagcatggtgttgtttaccgaatagcggtggaagcgggacatgacggacagatagcgcatatacttttcactctcaaacagttctttgatgccctgctcgatgccatctgtgatttcccttagccgttctcggttggtgggtttgttctcagccatgattttcaatctcctttccaagtgtgtgatttctgctgtgtgttctgcaatccatgccttttgttcttcttcactttcataaagaaaaaggtccagcaggtattctacataggctttcttctggattgcttccacaaaacgggggtgcggttcttcctccggtgtcctgggagaacggtcggcttcccattttttcagcagatagtagtaatcggacagtacgcgataacagcgctgtcgatcctcccgaaacttctgtgcctcggttttttgccggacatatctcctgcggggcggggcctgactgtcatagatcaggccaaagtcctgcgccagtttctccgccgcttcttttggggagaggtcaaagagctttgcggtaaagtcgatcacatccccatcttcaccgcagccaaagcagtggaatcgctggtctaccttcatgctggggttcttatcatcgtgaaaaggacagcaggccatgccatttcgcctgacttttatcccataaaactctgccgcttctctggtgctgactgacagcttgactgcttcaaatacattctctgccatgtgcctttaactgctgggctttctcacaggaggctggtatccggcagctttcgcacgctcactggcagctttgcggcgctcggcgctgtatggctccctgactgatacacaccgcttggggacggtaaagttatgggcgtcctttcgggtgatctggtcggggtgcttttttgccagcagttccagcttctccatcagacggggatcgtgggtgtagacctcagccattggttctgcctggttatagaggagaatggtttcccgttccactaaagagagcttcatcggctgcctcctttccgctggtcaaattccagcttgaagttggcgtactgtccatcatcctccaaaaccacagcggcatcgtaggtctttccggttttctccgaatatagccccgtcacacggacacagccatcgttcagcagcgcagacaccacagctttggtcggctgttttttcttggcagcccaccatttgttgtttttccagattgcaaatttgcaagaatcattctgacagaagaagcctttttgcagttctgcaacttcaccgccgcagcgagggcatttgcccaccacctcgcggggcggagtgaacaggtactcagttcccttgatgacctgataagtccccaccagatctttcagcatggtgctgatcccgtccagaaactcctccggggcaagctgcccgcgctcgatctctcccaggcggtactcccactcggcagtcagaagcggcgattgcagttgttccggcagcaccgtgataagggatactgcatcgtgggaaggaagaagctgcaccgtttttctgttcttttttcgctccagaaaaccggcagataccagcttttccaaaataccggcacgggtggccggtgtccccagaccttttctctcagcatcctctggcatatcatctttcccggcagtctccattgcggacaatagggtgtcctccgtaaagtgctgaggcagactgcttttgccttctttgacgattgccgcagaaaccgaaagtgtctgtccttcggtcagctccggcagggctttctctacgccctcttttttcggctctgtatccttcattttggcacgataagcgtcctccagtgctttccatccgggatgcttcactgtttttccttttgtggtaaactccccaccggcacacgctgcaatcacaacggtttccgaatagatatggggctgggctacggcgcacatcagacgcagggccaccagctccagcaccgctttttctcccgcaggaagggcagaaaggtctgcatccttgagatttctggtagggattactgcgtggtggtcggttactttcttatcgttgattaccgtctgcggatcacaggtaatggcgattcctttgcgaaacggcatagcattggcaaccagattgaccagcaccggcaggctgtctgccatatcgccagtcagatagcggctgtcagtacggggataggtgcagagctttttttcatacaggctttgcagatagtccagggtctgctgggctgtaaatccaagcaggcggttggcatctctttgcagagtagtcaggtcatagagggcaggcggcttttcggacttttccttgcactccacctttttgattgtgacatttacaccctgacaggcttctttcagctgctcagcagcagccttatccgccatgcgctccccggatacggtaagaccgggcagctccagcgccacggtataaaagggaatcggcttaaaggtgtcgatctcagcttctcgctgaacaataagcgccagcgtcggggacatcacgcgcccgatgttgagggttcggtgatacagcacggaaaaaagccttgtcgcattgatccccaccagccagtcggccttggcacggcagagggcagcatcccgaagtccgtcatagtccgcaccggggcgcaggtttgcaaagcctttccttatggcggagtcctccatcgaagaaatccagagccttttcatcggcttcttgcaacctgccagctcatagacgctacggaagatcatctcgccctcgcgtccggcatcacaggcatttaccacttccgtcacatccggggcattcatcagctttttgagaatatcaaactgctttttcttatcttttcccaccaccatctgccaatgttccggcaggataggcagatcatcatatcgccacttggcatactttgggtcatagctgtctgcatccgcaagaccggccaggtggcccacgcaccagctgacacgccagccgttgccctccagatacccgtccttacggacggttgcaccgatcacagccgccaaactctgggcaactgatggtttttcggcaattaccaatttatgttgagccatgatggttcctcctctctttgagccatcgggacatttcccggtgacagatacctacgcagggtcttccataattcccgcaaccatagcaggggtggctgtggggtaaagaaggaggacgggaagtttccttcccgccctccggcctgcgtgtcatcatacgttcatagggactgtctgtgaaacgggtcatttcacactgtcctcatcatcttcttctgtgctgcccccgtcagcatccggttcttccgactcctcatcctcggtttcccattcctcggaatcttcctctccataatcataatcgtccagactgtcattgcccttggtcttaggcttattcttaacgagcttcaagtaggcaaatacgccaccgccaccaagcagagccagcaaaaggactatcgcagccgggttcaatccggcaggcttctctttttccggctccgacgtttctgccggaggttccggtgctttgcccgtacatttactcttatcagttgcgcagaccgggcaggccgtattgactgcccctgcttcacattttgttgaacagctgcataccgcaggcatctcctctttgggttttccatcttccatcagcgccgcaaggtctgcatcgtccacctgattcagaaagtgaacagcagtctccttgtcctcattcgccctatcaatcaggatgtaaaagtaatttccagctttggtcgtaacagtaataagctgcttattgcctccaaaatcatccaccaatgccgcattcccctccggtgtaagtgccggtgccggttctgtttcttccacaatcacattgctgtcattggtagaatcctctgccggtgccgccggagcctgttctgacccctgtgcgaaagcagggatcgtaaagccaaatgccacaaccattgtcaggcaaagggcggaaagtgttttgcaaattcttttattcttcataagcggtaacctcctgattatttgattccgacagtgctgtatctctgccgtggttcattccaccggaaagcatagcgttcagctgtgctggagtcatgcgtaacgcacgaaccatctgaacgatttccagattctctgcctccgttttctgtgcttccagggtcttgagcttttcctgatattccgcaatcttctcacgggttttctcaatttcctggtcgatacgttcaattttattttttgccataaccgttcactcctttccacaaagtctgttaccagttcatcaggccgtagcccttaatactttgataattcaggtcataacttttgatcttgcaggcatcgccggaatttccctccaccgtataaacacggctgccatccgtaccgatcacgatacccacatggtctgctgtcccatctaaatcccaatcaaagaaaattgcatctccgggagccagattgttatagcctcttgcaccccattgtccatgagactggaaccacggaacgccctgccactcacagcctgcaaagcgcggctcactttttccagcctggttataacaccaggatacaaagcaggcgcaccactccacgcggctgtcaaagccataccagctccaataaggatagccgcccacattgccgacctgacgcttggccagctccaccaactgcggatttccgggacgggttccatttacaaactgtacaccggtcaagtcctcggaattgctcatgtcaggggaaccaccgccaaacaacagcggcttattgcccatggtctgccggtaaacctgatacatttccatctgctccggggtcagtaactccgacgccacagcggaaatgggcttgctggtgagtttcacattcaaaatgtaatactcataggggacttcttctgaggtggtctcgccggtctccgggtcggtggaggtctccgtgcggtagcgaatctccacttcctcagtaagcgtcagctgatactgtgctgcaaacacacgcgccagctctgcctgagcgctctgccgggtgtaaccttgcaagacggcagacagaaatgctgccagctcatgagggtcatggccgatcataccaaggtcatagcgatactcgtcataccctgggtggctgctttcaatgttgtcgatttcctcctgcaactggacttctttggctgcataatctgcctccactgccagcatttccgggtcatccgacggataagtggtgccggagagaacggaaccgatgctctgcgccatcatggagcaggaggacatggtattcatcagcatacaggtaatgaggaacaaaacccctgccatcaggaaacccttcttgtggcgcacgacgaacgcccctgcctgctgtgccttttctttcaccgtccttgcggcttttccggttttggacgcagcctgggcggtatttccggcagtctgaccggcgtgtttggcggcggcatactgccttttgatggcctgcttttgctgccagcgggaaagcggattgctggcaaactggggattttcctgcaaagatttctggtacagaacatttacatttgccttttccagttggcgctctgcttgggctgctttgcggtacggcttcagcttgtggctgcgatagccctcccgcaccagataagcgccggtctccaccgcttcctcggacttgtgggcgctttccacgcccacattgtcctgctctgtttcccggatctctttgtggagcttgcctgcgaccagatggacgggagcttccctgactccttgagaaactttggaaggtggctttttcttgtcctcaaaggtcagcttcgaggtcttttttccggtatccgggtcaatgaccgtctgcctgacctttttctttgggatattggcctgcgccttatctgctctggccgcagctttctccgctttacggatcggcttttccagtgcaggatcagaccgttcctcatcagtaaagcgcaggcgcggctccttattcaaaccattctcccagcatgagggaggacatcatgtagtgcagctctgcataaatggccattcccaccggatcgttgaacatacagccggacaggtaggcataaaactgtgccaccacatcggacaggatcttcgcttcggttccttccagaaccagaccgcccataccttccttggcacggatggtgctccagacctctgccagacggagtagccccacctgaccggtctcattcagttcggctgcctgatctgccgccgtgcggcactcacttaccgcatcggccatgactgtaagcagctggctgcgctgggcatttaccgccctgtcaaaaaacatcagcggattcttattcaaaatgttggggttcatcatcattcatcctccttctttttcagttcctggggtttggtagtcataatgcggtaaagttcggtgttcttcgggaagtgatccacaaacggcaggatcgtggagccatagaacagcaggccctcgccctcaccggagtgggtcacatagctaagctggtgcgtggaaatccccagttgcttcgccaaaatctgacggtctccgcctgcctggttaagcatatacacgaagtccgagttttcaaagatgttctctacctcgcggctgctcaaaaggtctttgacattctgggtgatacctgtcggaataccgccccattttctgaatcgcttccagatttccaccgtataggcggcggtctgctcctccttcaaaagcaggtgcatctcgtcgatgtagtaacgggtggacttgtgggcggcacggttgatggtaacgcggttccacacctgatcctgtaccaccagcataccgatttttttaagctgcttgcccagttccttgatgtcgtagcagacaatccggttatcaatgtccacattgctctgatgattgaacacattcaaagaacccgttacatagatttccaatgccgttgcaatgtactgagcttctttttcttcctgctcccgcaacaggttataaaggtcctccaaaatcggcatattctccggcttcgggtcattgagatattcgttgtaaaccaaccgtacacaacgatcaataatggttttctgcaccggctgcaagccctccttaccgcccacgatcagctcacacaagctgaggataaagtcagacttgagtgacagcgggctttcatcatccgaatagtccagattcagatccatcggattgatatagttggttgaagtaggtgagatcttgatgacctgcccatgcagacgctccaccagaggtgcgtactccgcttccgggtcacagataataacatcatcactggtaagcaaaaagcagttggcaatttctcgttttgcgctgaaggacttaccggaacccggcgtacccagaatcaggccgttggggtttttcagcagctttctgtccaccatgatgaggttgttggacagagcattgataccgtagtacagagcttctttcccgttctggaacagttcctgcgtagtaaagggcacaaagatagctgtggaactggtggtcagtcctcgctgaatctcaatctgattgagacccagaggcagacagctcatcagcccttcttcctgctggaagtccagcctggtcagctgacagttatacttctgggcaatagagcctgcctgaaagatgttgttgccaagctgacggggattgtccgctgtgttcagcaccagaaaggtcaaaaggaacattctctcgttgcggctctgcaaatcctgcaagagttttttcgcttcactgccgtaggtagcaaggtcagatggaatgatgtccatgtcgtatccggcacggactgcttttttctgttcctcgatcttgctgcggtccaggtcggtaatctttcgctttaccgttttgatggctttcacctgatccaccgactgaatgtgcatactcacaatgagcgaactttccatatccagaaaatcagccagcaaacggtcattcagctccggtgcgagaatctgcaaaaaagaaacagctccgtatttcttacccatacggaactgcttgccggtgcggaactcaaaggagcttggtgcaataaaatcctttgtggacagaccagaaggagccagccagtcccattcaaactgaaacgggagttgttcatccatgtggaataccgcatgaagctgaaaaagcctttctttaccgtccagcgttctggcagctacaccaagacgcttgaagttattaagtatatcggtctcaatacgctccagacggggcttggcggctttgatgctgtccgcgtcgataccaaaggtcaggtatttggtcttgatgagaccgttgttacctctggccagctgattttgcagcattgtggtgtattcctcgcggatactgtcaaaggcgtccctctggggcgggatggaaatggagttagcaaaggtctcctccgatgccgcaaggttcaaaaaagacagctggaaatgaatcgagctgtcaaaataattgaggaaatcacaccacccctcaaagattgccgtcttatcttcgttttgggagagctgatagttgatgtcctgaaactggatggtctttgtgtagtggctgtccgatatgcggcagattccgtccggccacatccgttcataagggatactgtcctgcgcagattttccttttttgtccgtgcggttagcgcgggcaatggccgcttcgatctgcttcttatcggcgcgggacagttttttctttgtctttaccggctgcacagttttttcctcggtttttccgaacatccgatgcagccatttttttattgcggtgaacaatgtcatacacctccttatcgagcatttcctgccgctttaatacggcataaaagttgttggtctggtaaggtcgctgctttggacggatcacagctactttgagaatgttgcccacgatcttttccaggggctgtccatgcttttcgtacatagccagcataaagaagggcagcataaccagcatcatacacatagccgctacactgtttccggtaggttttctgagcaaaaagaaaagcggtacgccaataagcgctccgcccgtgaagcagataagctgccgcttggtcagattgaacatgacctttgttttgacttttgttaagtccttgggtacgggtacataagccaatgtggaaacctccttccgttttagtgcgcctgaaagactgatttggcgagactgccggttttgaacagcgtaaaacatagcagtacagtgtagcccacgcagctccagattgccatgatgatgtcatcttccatagcgatgttctgcaccagcacagcataaattgccacgcagacgataatgagaaacgcctgaaagcccagtgccagcagggatcggaggtaattctgtcccataccgccccattctttgcccatcattgcagccattggaacgggagccaccgaagttacaaggtagatctcgatcatacggccataaataacgataaagatacagatatacaacgcccacatggtaatgccaataaagagggattggaaccacagtccgaacagcggtcccaaatccatttccatcagcctcggttccaaatcggtcataactgaggaaatgtcaatggacgcatccgaattgataatccctgccgcctgcgccaccacgctctgcgccatatcaaagacgcccatcacgatattccatgtgtttgtgacaatgaggatggcggcagctgatttgaacacccacttgaaaatcatccaggtatccacatcatgcaggttgttcttgtctgcaatcatctggatcaggtctacggtcataacgatagccaggatcacacctgcaatcggcaccatgatggagtttgacagattctcaatcatattgaaaatactgccattccatccctgtggggtctgtcctacctgtacggatatatccgcgacctgttggtttacgctgtcaaacatccccgaaaggttgctcataataccgcccaccagcatttctttcagccaatttgtcagggcttcaagtaagaaatccatacggtgtcaacctcctttccgccgcccccgcagagctgcgggagcggcaaggatttcatgcaggaacgcttagacagagaacagcccggagagcagaggtacaagaaccataccaacaacggctacaccagcgccagccatgagctgttttatccccaattaggtgtaaaactctgctcgatggcgggcggcggcgtacaaaaaatctatatggtgttgttaagagaaccgtcccggcgggacaggtcaggcagtgacctgttccacctccgggatgggtttgagattaaaatgaatttcgatagaaatgtgtcttgttttatcttcgtcaatgcgctcatgcacgacgatttctttgattaagcggttgagggtggctgcgtccaactctgtgatgttggcgtattcctgaatggcttccacccattgttttgcgtcattggcaagctggacttcatcggacagccgctttctgccctcagacacttttgttttaagctccgtctgctcggtctgtgtcttttccagcatggtgttgaaattctgctcactgatacgccctgcaatcatatcctcataaagccgcatgaccattttgtccagaacctcaatccgttcctcgtcccttgtaagggagcgttccattgcttcccgctgttcacgctgctcggcttcacaggtattggtcaggcggtcggcaaccgcttccccgtccatcagggcagctctggcacattcccggattttccgcagtacatggctgtaaagggtgtcataatcaatccggtgctgggtgcagtggttctttccaaaggcattgtaggtcttgcaggagtaaatctgctggggatattttgcgtttgtgtagcgtatcgtcagcgacttcccacactcgccgcattttatcagtccggcaaacaggctgatttcattggtctgccccggacgctggcgggatttcagcttgttctgcacaatgtcaaagctcatgcggtcaatcagcggttcatgctgtccctccaccacaatccagtcctccggcttcttttccccaatcgtgccgattttgaagcggtagtcctttttctgggaagcaatcgccccggtgtagacgggattcatcaaaaggtctttgataacggagaagtcccacatataccgcccgttttccgggtctttcttttcccatttggtgcgggtattgcgaagcccccgttcccggttccaccatgtagggcaggggattttttcttcctccagccgtctgcggatatagttgggaccatgaccgttcagggcatatccgaaaatcagccgcacaatcggggcggtttcctcgtcaatgagcagatggtttttgtcctccgggtctttccgatacccaaagggggcaagacacccggtaaactgtcctttctgcgctttcagaagataggaggaatggactttcttggaaatatccttgctgtacatttcattcaggatattcttgaacggggcaatgtcgttgttatcccgcagggtgtcgatgccgtcattcatggcgatatagcggacaccgtttcttgggaaaaagtcctcaatcaaatgcccggtttgcagataattacgccccagtcggctgaggtctttcgtgataacaaggttgatctgcctgcgctcaatggctctcaacattctctgtaggtcaggacgctccatgttaagacctgtgaagccatcgtcctgatagactgccacaacctcccatccctgcttttcgcagtatttttccagcatatcacgctggtttgcgatactggcactttcgccttgcaggtcatcgtcctttgacagcctgcaatagaccgccgcacgataacccccggcaagtgccgaaccgattgttctgtattccatttcgttcatcatagccatttacccacacaatccagacggtatctggctcttttgaacctcatcttcattatagcctatatctttctttttagcaagatattcttttgcatttgtctttccgtatttctgggaaatcaggctgacgaacacatcagtggcgtcaagctccccgtcaaatacagtggtcacatgaatctctgttttgttttttgccataggcagttatcctccatacatgaaaatagccagacagagggtgtcggcaacgaagtccggcaacggacttcaaaagaccttgcaaacaatctcaatctggcgatggttactatttatacttttcttttatttttttgttgttttggttgttataagggagaaaagcccggaaataaggggtttttcccggcaaccggctcggcaacgggataacaacagggggtgcaacgggctgtccttttcagaatggaagctccatctgttctgtgacctccacaaaaccgtccatcgttttttcagacgggttgccggagtccgttgccgggttttcacgctcccagcccttttgtctgccatattcggaaaacattcttgggtttgggaagtaccgccagctggaaatgcactggttcataatctcgttgatttcccggatttcccattgcttcggctcgtcaaaagcatggttcaaggcttccttatagagctgcttggagcagaccatgctcccggtgtatttatcaagatacgcctgtatcatcccggctttggtgtcctccggcataaaatcccgctggtgttctttgagataccgctgcatggcggggctgaaagccagcttgaacctgccgcttttataaatctccatcgcttccgcccacatctgcccgatataggctctggaagcggcttcatcctccaaaatgtgaacttccgcctgctccgggtacaccatgaccgggataaagcggcggttgccggaacggtcaaggggcaggaagtcaagggcattggaagtgccgccaaacacgcactgacgggggcggtctgccgggtgggtttcataaggtatcttgtagacctctttctgccggcttaaaaatgacttgatttcctcaatgctcttggcgttggcggttgccatcatttccgacatttcaataatccagtgaccttgcagcttgcggtacacattgtcatcgtccagcttccgcaaatcatcggagaaccactcgtcccggactgccagcagccggaagaaggtggactttccagccccctgaccgcctaccagacagagcatgatttcaaacttgcaccccggctgaaaggctcgtgagattgcacccagcaggaacagcttcaacgcttcataggtgtaatcgtctgcgtcagcccccagaaagtgccgcaggcagaagcggattcgctctgtcccgtcccacacaagggtattgagatagtcccggatgggatggtacttgttttcattcgccacaatcccgatggcgttatcaatctttttctcattggtaagcccgtaggtttcttccagataaagaagcagatacttcatgtccgtatcgttcagggcggtgctttctctgtgaaaaccgatgggctttatgatgtccttgcggtcagtcaggatgttgtatgcgatagcccctgaaagcagagggtcacgttggaatacggtcaggcagttccgtatgctctgacggacaccgcctttctcggtggtttccagccccgccttgatttcctcaacgctctggggcggctgcatggcgttcatagtgttttttagttcttgctgcgtctgcggctgcaagttctgccattcgctgttcaagctgtatcacatcctttccgtagtccgtaatcaaatccgctttttcctctgtttccccgaacagcagcacatccagcagatattccacttgggcttgcttctgtaaggcttccacaaaccggggatgaaaggcttcctccggggagtgcggggcgtagtccgttctccatgccatcagcagatggagataatcggcaagaatacggaagcagcgattctttgcttcctgaaactgttcctccggggatttctgccgggtcttgggcttttttacctttcccggcggtttccagtcctcataggaaagcccgaagtcctgtgccagctgtacggcggcttctttctttcccagcccatacagggcggcggcaaaatcaatcacatccccatccgcaccgcagccgaagcaatggtaacgccgatccagcttcatgcttggggttttatcgttatggaacgggcagcaagccatcccgttccgacctacatggattccataatactccgcagcctgtcttgttgtgacggactgcttcacagcttcgaatacattcaaatctatccctccttgaaaataagaaaagcacctgacattctctaattgaaaatggcaagtgcctgttaaagttccatatcctgttgtctgtgtttctcctgtgccggggcggttctttgtgcttttttctcgtcagtcttatcctgcaagacttctttgatgggctgcttcttgggcggctctttgctttcctctgtgccgggtgtggctttccgtacccagtagcggatgtcccgcagcttcttcaaatcctcctgtacctcggtcagtggtactttcagctctgcgatttcgctgagaagcgtttcctgctcctgttgcaactcatttttcgttttatccttatcgtccgggtgcttggcaaggtagtcagcggctttctcataccgggcaacctccgggtgttcctgtttgaatttcccctttattttcttaaaaaatatcttctggtacttctcatagacagccttacattccttgcagtctgtccggctggcaagaatcccgtcaatcactttgctccgggcttcctttggcttcatctgattgcggtaatctgcggctgatttcccggaagattccagaaacgcttctaagtcctccacagtggaaagccccttttgccggagataggacagggcttcgctgactgcctttaagtcctgtgaagttccccggttctgtccagcccttgtccagtccttccgttcttcctttcgtatctccatatacttcatcagcagattgggaagaagtgtcgcttcctccgccgccttttgtgcaagcagctccttccgtttttctcccagctcggtaatccagcctttgaggttttggataagctgccggatggacttcatcaggcggttggcggctctgatttcccggttcaggttgccgatattcgtctggatacctcgcttttccatctgccggacagcagtcccctcatggacagtggggactatatcaagcccctgtctggcataggaacgcaagtccacacgctccgggcggtcattggcgtccagatagcggttctggataacctcccattcatgccgccagatttcacaatacttctggtcgttccagtccaccgtatcctccttgtggcttttccacctgccggacggcagctttatccgttccccattctcgtcaaggtcataaaccttgcggctcttgggaagccattttccatgttcatccattgcccgcatggtcagcaggacatgggcgtggggattgtgtcccggcggatggggggcatggatggcaaaatcagcaatcatgcctttggaaacaaactgctgttcacaaaactcccgtacaaggacagcgtactggtcgggcggtatctctctgggaatggtaagcacccaccgccttgcaagctgggagttccattgcttttccaccgcttcggcggcattccataaagtattgcggtctgcatattcctgtggagcatttgccgggagcaggatttcattgtggacgataccacgcttttccgggtagtgctttacttgctggtcgtattcacagaacagcttttcgccgctttggtaagcagcggcggcaaccgcagactgccgctggctgcgctgaacaatcgtgatttcgttgtgtggacaaggcatttcgtgtccctcctttcgctaattggtggatggggtggcgttttaccacctcattttgggcagaaaaaaagcaggagacctttttcagatttcctgctcggtgtgccactgtgtgagcggcgggtatttagttgtaaaagttcgggacaagttgacccgatgtaaagctaacaaactggaattgcaccaaaacaatctaagacaacaacgctgccctacttgcgattttttcttgtactgcggaaacagtttcttgaatggaataagtggtcgtatctataacattcgattcatatattcccagattgcaaaattgctcccacatggtttctaccaattcgatatttgtctttcggtctaactttgagcgttcaacagctcgcttcaaggtttcttccttacttgcccttaaaataatataatgcacctcataatgttcccgaacaagactttgccacggctttaaaaaccacggtccgataataccgtcaacaattacatcatatccaccacgagcatatcgcttcgcagcttctaaaaacgcttcaatgacaatcaaattttgctcatttgattctggcaaatgcggtggtattgcccctttactcaaataatgataaaagtcatctgtgtgcatatgcacagacttttccaaatctgattcttttgcaacagcagatgccgttgtagtttttcctgtccccggcgcacctgtgattacaataattctaccttgattcatctatattttacctccacaaattacgattttcttaattctacaaacttgaattgagatttcatatattcaaagggatttaataactgttatattttattatcaaatatctctcaagcccttgaaaacactaagtttgtcgcaggtgagctttcccttattgtttcccttgtattatattgtcccatgagtttttacgaactctgataagggaaaaaacaagggaaagaaaatcttataaaatagtataacacaaaataaaagtgacatggggaactgattgaaatgcttctgatttttgcaacaaatgattgattgaacgataaggagatttgatacgatgagaacgatatttgcagaatacaatccacaacgcaacagcattgatgtttatacttctgctggctatatgctccgcattgactgctgggaagcggagaagaatttaacaactactcccggatctgactgtgcattaaacgcacttgccattgatgaaccacttgagtatgcaagattgtatcttgatggaacgatgcaaatgtggatagatgcggaagattccttttaggtatacgcaagaaacggcggctctgatttctcaaaaccgccgttaggataataacttaaaataggcgcgcaaaatcacctgccccagccagcgtttttttctttccccgtagtcggggcaggttcatgcgctatgcaattattcttctttagcttctatcaagccgatattttttgctctgcgttccacatagcagcatattttccgcctttcgcaagcaattcctcatgggttccagattcagcaatcctgccatcacccattacaaggatttgatctgcatttttgacgatggaaagggtatgagcaatcattaccacagtctttttctctttcagcagattggcgatggcctgctttactgccagttcgttctcgatgtcaagggacgctgttgcctcatccaaaagcaggattgggctgtttttcaggatagcgcgggcgattgaaattcgctgacgctcaccgccagagagaagatttccattctcgccagtcggcgtatcgtatcccttttccatcttacggatgaagctgtcacagttagcctcccggcaggcagcctcgatttccgtgtccgtagcattagggcgagcgtgtcggatattatcccggatggtatcgtcaaaaagaaatatgtcctggtctaccatagaaacttgctccagtacacgctctgcggcaacatggttaatgggtttaccgccaatagaaatcgtcccgcccgttgcttcataatattttgcaatcaggttcaaaatagtagatttgccggagccagagtctccgataatggccgtgagcttttgatctggcaccgtaaaggtggcgtgttttagtaccggttcaccgggaacatatgcaaaatctacattgtcaaatgtgatttcatgggtagctgtgtgaagcggctccatgctgccagtttcctccggctcattcattacactcaagattttgtttttcgagatcatcaggttcttataactggtgaggtctacaaaaatcgaattagccagctttgcacagaacaggggcagcatacaaatcaaaaggtagtccaccgtgttcagtgtccctgcgacccaaggtgcataggccagcaagataaccagcgggcaggacagccaactcaaaataccaaagaccgcaccaataggaagcacttttgattcgtacacaaagctgatccgacagaactcccgcatagcgttgataacggttttattcttcaaaccacctacgccataggcccggaaagtttgaataccagacacatactccacaatgctgctgacattctctgcacaaatatcattcttttctttaccatacttccgaaccatacggaaggaaagccacagtccagggatcaaaagcaagtcggcaatcagcaggataattccggcaggcacataaatggtcatcacaaaaataatcagcatgagcgaaagtgcaaaactctttgccatatcaccgatcttatgggtcaggattttttcatagttgtttacatcgcttgtgatggtattgatataatcgccggtctgtccctgggtaaaccgggaaagcgggatacgcttcaaatggtcgcccataaagaggcgggtattcttgctgacctctgcaccgccgatctgcgctttggtatagccatagctgtaaattaggatacgaagaagaaaaaccaccgcgatcatacaggtcagaaccaggacacggttcatgtcaaattgtcccgaccacaaaaactgcatgacagagtaaagcagcataaacaggctgccggagagaagcccttccagaacagtcccgccaacgccaatataaaaattacggttctttttcaatacatcatgctcactcatgctgctcgcctccctccaactgataagtaatattccgggctgtttcgtagtcctcccacgccttccgatagtaagcattgttctttcggacttcctcatgggttccgacacaggtaattgtgtgattttcaaccactgctacacgctcgcacatcttcaacgcgctcaaacgatgggctaccacaatgacagtctttcccttacagagattttgaatggctttgtcaatctccatctgattttccgggtcagaggcgcttgtggcctcgtctaagatcaaaatgggggcattcttcaggatagcgcgggcaatggcaatccgctgtttttcaccgccggagaagcgagagccgaagctgcccaccttcgtgtcatatccatccggcaaagacatgatgaaatcatcaatctgcgcctcttttgcggcggtccgtactttttccagagtggcgttactgcccatgcggatattttctaaaacgctgtcacgggtcaggaaggtcttttggaacacaatggcgacattttttaggatagtatcataattgagttcctttacatttttcccgccaatcagcacttcgccctcctgcacatcatagaaccgggagatcagctcaatcacggtacttttaccggcaccagactgtcccacaagggccatgcgttcaccatctttaattttgagattaacgccttgcagtacatcggtcttgccatcataggaaaaccgaacattccgaagttcaatatcgtgattttggggaaagtccgctccaccctcataaattggaatatccagtatctctttggtcttagtaacagcgttcagcacattggcaaaattagtccccagttcctgcagggggcgtatttccgtcagatacatggaacctacatagacgaacagcaaaaatgcgctggcagccagtgagcctttcaggaaaaacattccgccgattggaaccatcatcaacatcccacattcgatgataacaacaaaggccgcataaggtggccccatgcgccgggaagtttcattccacatggcgttttcttcctggatagcgtctgaaaacttttgaaacgatttgctccccatgttataggctttaatcaatttcatgccgctgatgtactcaatcataaccgagttcagtgtggtaatggagtgattggcccgttccatcaggtcatccgtattgcggaacatcatccccattacaacaacagcaaggatcagcggaaccagggaaatcaatgccagaggaatattgacggtcatcagataaataaagatgactaccggccccaccagatagcacacaaggtcaggaaggttatgggccagaaacagctccaacttttcaatatcttcattcagaaccgtttttatgtccccggtgcgccgttcattcaaggcccctaaaggcgctctggccatgtgttctgcaaccatgcagcgcactttgaaaagagcgccataggcccctttgtgggctgctacgccggaacagccaaacagggcaaaccgcaaagttaccgccactgcaatcattaccacggtatgtacaacaagttcctgcgtgcaggtatgattgaaggtggcgtccatcagccggtaaattccaatgtaagggacgataatgcaaagaccgctgaccgccgatagaaaaattgccaggaacagccagattttttgctcaccggcccagtggagcagcaaagctactctgttttcttttttctgtttcatagatcacctctcctttccatctgaaacagagaacagctctctcaatttcgggagggcatccattgtaactggtacatcatcgggcatttcgccctcgtcaaaatgcaggacacgggagcaggtacggcagacaaattcaaaatcgtgggtgacaatgaaaataacctttcccatattggacaaccggcggatcagtcccgccacctgcgtcatactgtcaaaatcaaggccgctggtcggttcatcgaataccagcagatctttcccacaaatcatgctaacagctacagctactcgttgcttttgaccgccagaaagcgtgtttggatggcgctcccgatattgggtaaggcctaattcctccaaagttgcatttaccagtgtttgatctggattgcgtataccaaaggagcactctgcctccacgctgtcagcgaaaagttcataattcacatcctgcataaccatgtaagagcgtttcagcctttccttacgctcaatcggctcgctttcccacaaaaattgtccatcgcagtctttgtgaagcccacagagagcgcgggaaaatgtagtctttccagctccgttgtggccgacaacaccaatcacttcgccctttccggcggatagctcaatgtcatgcaaaattgtttgcttcttgtaacggagcgtcacattccgcagctccaatacaggggtaggcgcaggcaagtgggctttttgcgggaataccgcctgtagatcaacagctcgcagccccatgtgttcacgatcaggttcagatagctgccaaaattcttccggggtgtatattcctttgatttctcctttttccagataaacaattcggtcagccaactccatcaggtagtacagacgatgttccgctatcaaaactgttttgccctgtttttttatcagccgcaaatgttcctttagttcctggatcgaagtcatatccagattagaggatggttcatccaatagataaatctgtgggttcatggcataaacagaagcaaaggcgattttctgcttttctccgccggacaactcaaaaatatttctgtttcgcagcttttgaatatgcaaatcttcagttgtctgctctactcgctcagccaatttctcaggagggcgagcttcattttcaattccaaaggcaatctcactgtctgtatcaacattgaaaaactgcgtccgtggattttggaaaacggagccaaccttagcggcaatctgatacatggggatattgctgatttcctgaccatctaccagcacacggccatgaagctccccctgataaaactgagggatcagtccattcaccagccttgtaatcgttgtttttccgcacccgctgcggccacagaacaggacgaattctccgtccgaaattttcaaattgatgtcgcgcagcccaccatgttcctgccccgtataggaaaacgatacattttcaaactcaatcaaccgatcacacctcctcgcacacataattcaaaaatcagataagctacggcaaaggccatgacgccccaatcggaaattccgcattttatctggacaagacaggtgcgtggattgggattttcaattccacgagtgacagaagcaacagaaagatcatccgccgcttttgaagctgccatcaataaaggcacataaatacactcaaccgtcatgcccggatgtgttaaaaagcccgccagagatggtgaaacatctctcattcgcatagcgtctgtgatatagcgccagtcctcttgaatagttggaatgtaccgcagcataactgccataggaattactaactttttgggtgcgcggacacggttcatagcagacaggaactcattgacttttgtagtagtcagaacaatcccagccaaggttccgcacgcatagaccttatgaaacaagcctaaaaaggcaataaacattgtccgcagcgtgcctgtcatttctgccatgatccaaactgtcagggcacagatgaccgcataaaagcatacagccttaatgacatatttccactttccaaagaaagcccccaatatcgcaatcagcataacaaggataaattgatatgcaagtgagggcgcaaacatggacgataaaacacacataagaataagaaagagcttggcccgtgggtcgagccaaagctctttcttatggcgtttaccgctcatgctgtaatacctgctttttcaaactgctttttcagcattttgcagcctacaaaagcgctgattgcagatgtaatgataacagcagcaaacatggcaatcaggatgccggtatttgcagttgcctgcatggtgtcgatgtaactctgttcagttccgttccccagcatggtctgcgcccagccgttggggtcaacaaagaacacgatatatgaaccagtgccaccgagagagaacaggatataagacaggctgttgagttttttgcttttgtactgccctgcaccagcaacaaagtccgcgacaatcgccatgatcatgtagcccaatgcaaaagcccagtgcataccagtcacgaaccaaataatacccatgataacgcccattatagaaagactccaacgcttatgtacttttgcaatcagcaaaagataaatggggccagcaagcagcccacctcctgctggcatgaaaaaagtaagtacaggattcgttgcaaaaaagacaccgcccaccaatacaaaaacaaataacagtgcagtaaaaatacctgttgttacaaggtctttcactgtcagacctttgttcatagaatttacttgattactcattttgacctcctacctttcattgccttgactcgacaagtggtttgtgatattcttcggttagatacctctaatcttcgtctaatacaatacgcatttatcgaacaacattcaataggttccggcaatgttcgtctgttcctttcaaaagttcgtctaatcgttgcaaaaaggaggcggtctgttttcatgtctgaaattattgaccagttttatacaccgctactaattgaacacggttttatccgtgacccagacaaccagcaatatggggcattaggtgactgctggaaactttctcccgaagttggagaaggcacctactggacttatggacagaaagacttatatgatattaaaatccataacttttccttccacgaagatttcatgttggaatgctctatgccggaatgtctgagtatcactcggtatgactctatttccggggaggaattatctccataccgtagactgtctgccggttgtatcaaaacatttattggaggctacactccatacaaggctttgatacataaaaatattccaatccgttcggttgggattgagattgcaccggcatattatgaggactacctgaaaaaactgtacccggaggcacagatcaatcctgtggatgcatttcggaagatcgaccaaacatccgactttccagaaatgtcacggttactcactgaaatcaaagactatcgcggggaagggattgcagcaaaacttttttatgagggtaaagtcgcagaagctgtttcaatggtggtggaatatcagaagaaacatcctaataaaccagcccataagctctctcaacaggatattgaaaatctccaaatagttgccgcttatcttagcgatcactatgcttttgatattcctctggaacggctaacacagattgcctgcatgggaacaacaaagctcaaaagctgttttaagaaatactacgactgcaccatcacggaatatgttcaacagcggcgcatgagtcaagcagaatatctgctggcatatacagaactgacagtcgggcaagttgcccaaacagtaggctattccacttcaagccgatttgcagaattattccgtaaaagcactggattgttgccactggagtacagaaaaaacgcacagcgaaaataaaatgagtgccagaggaaactctggcgcttgtaaaatttttcacccacattctagtcgggcttagccatgtgttgtggaatatatacggaatgcatcgtcaatattccactgctgcttgcggttgttaccaagatagtgagagctcatctgaacacaaagttaccattgccctttttcgtacctaaacgaagtaagatttcatgtacatgctcatcactgaatttttagaataatctgtcctagcacgaaagtaaatatgaatagtttctaatagttttttaataatatcctcttgcttcccgccatccctttacataccacctgattccaacatataccagttgcacgaataataagagaaatagcagattgattggcaatgctgtctttatccaattcccaaagtagatagctgttgccatgcttataagtattaccattatggtaatcatgtcccaacagtatttcttatatagccctgcaatctttatccctataaacgctacaagtattcccgcacccaccagacatccaccgcaaatcaatattcttatcagccagtatataattccggcaatgactggattggatattccattactaatctgtgccacattctttcctatcagtgcaatccagccagcaatagtctgtgtgaaagttccgattgcatcaaagaatattctgcaatcagaaataaatacctttgactgtatcatctgaaaaagagtagttgatgcggaataccatatcagcagaaacatcaatgcttcatacatgactgtttttgttttatatctgcctgccagtttttccctctgcgtatcatacttttctttggctttcagataagctgtctgattacaattctgacacttttgatagagtaccggcttttcaaccggtatctctacttttttctgatgagagagtgcatagtcccgttcctgttctgcctgccttagcttatcttgacattcctctgtcatgatttcggcagcgtgcgttttctctttctcgctctgcaacaattcttttgttttcctcaagtcgttctttaaggcttgaatgttccctgctctgttctcgctgtttaacctctcgttcaaggtcagcgattcgtcgagctgcattttcagttcccgaatagtccggtctttctggtcgagttcttcctgcatctgctctgtcagcagaagcaactcttccagttgatcgtcgctctttgagtttcttaattcgttcatcaatcaaccttcctttctctaattgctgttcaagttcagtaattcgctgttctgtttctgcaatagccggttctcgctgtttaatttctgtgccaatttctgccattgctgattttcgtctgtgagtttctgtatctggtctgtcttttcttccagaagcatcaacagttcttctgtatccggcaagatttgaagcagctctaataattcgctctctaattgctgcaatcgttcttcctgctcctgaaaacacatcagcttctcgtccttttcctgtatctcctgaagcatctctgccatgatattctgctgttcctctatctgtgtaatcattgcttccatcatgggaattacttctttgctttcttctaatgtcattcaaacactccctccacatagacaatgcaccggataccttaccaaaggttgcaattaccttttgcagcagtgcattttgttttttaatcatctggttttcctcaaccttccatgaacctttccttatctgtccggtgagatatttttcctcaatcttccttgcatctgcaccctcatgaatcgtagggactttcaatttgccctgtctttcataagagcggtggtcaatctgattgtctatggataaatgccggttacacatcctagcccattcgcttcgccataactcacaattttttggactgttccagccggtagcatcggtcagaacccgtttccattgttttctgtttcttgccccgactttctgtactccgttttcatcaagtaccggaatacggattccatgacggtctggatttttcttatcctgccaccaatccgggtgggattcatcaaccacgatattttcctcagtatctctgacaaaatcccagtccttgacttctttgttgccccatgaatgatccggattgaatggtcgcatggttacaagtaaatggacatgtgggtttccatcgttcttatcgtgtatgctccaatcggcacacattcccttgtccacgaaagttttttgaatatattcggttgtataatcaatctgttcctgtctgctccattctttcggtaaggaaaattcaaacgagcgtccaagctgtgcatctgcatttttttctatcttcaatacctcattccatagccgctgtttctgaaatgtgattttaaacttttccagtgcagcttccttatcgcctgcccttttataacggatagactgttgaaacctttttatattttcttccggtacatgcagccattcaggaggtgcattttcacacatcatcagactggtgtagacgacttcctttttggaagtgtagtagctgatcctgcctgtttcctcatttttcatcacatctccattaagatatgccgatgcggatatgacagattttcctttactgcgtccgacaatctttactgtaaagtgaaatatcgccatgatacgattccccctttctgccgtatccggcattgatttccgacagcatcttcttctagtttggcaggagtgaagctgtcggaacgccctctgcgcaagagtgccccctgcggcatgagcaggtctggctgaaagccccgccgacggaacgagcccggcaagcgtaagcgcagaccggttgccacttgtggcaaacttataaggacgacctctggttgtccataagtgcgcccttcattcaaaggcaatgaagggaatggaaaacccactccctccgccattacacttcctccatgtctgtaactaattctttctgcatcgcttttgagaaaaacttcccgtttgtttcctgcctttttaagaagcctatcaactttggtaaatcttcctcctcaatcggacagccaagaactgattccaccgctcctccaatctgacagagcctgtgggttcgttttttactttcttccgctttctttctcttttccagttccttccgctgtgctatgagcttttttgtagcttcaatgctttcctgttcctttttctctaatgcacgtattctttcttcataagtctttgttgatttcgccatatcgtcttcatcctttctttttccgataaacaacagttcccggttgcatatcaggagaagcacatggtataatcctcttgcgtgtaggtatatcatggcttcggtctgatagaacctttggcggtttcgtaagaagccgcctttttaagttgccacatttcttgtgacagcttttacatttcctttatccctcagatctcgtccctcgttggcttccatgaacttttccagaatgtcagttttaataaggacttttcttccaacctttaataccggaagtttcttccattcaaccagttttctcaaagtgtttctgccaatccctgtatagtcggctgcttcctcgatggataatgcaatctttctttccgtcatctcgtcacctccttgcaaattgcattatgcaatttctattgtgctgttagtatagcggttttatattgcgttgtcaagcgttatgaaattttaaaaataatcattaaattgcatattgcaattatgtgaggtacatgctataattcatacataccgaaaaaggaggcaatcagcatgaaagataaagaactacgcaagctgataggcagcagggcaaaacagcgtcgtctggaattaaatctgacacagccttatgttgcagagaagatgggagttacagcttccacaatcctgcgttatgagaatggttcgattgacaataccaaaaagatggtgctggaaggtctttcggaagcacttcatgtatctattgaatggctcagaggggaaaccgatgaatacgaaaccgatattacggataagaaagaattacagattcgtgatgcaatgggcgatattctcaaacagttacctctcgaccttagtaaaaaggaagatgctttttccaaagatttactgctgttgatgttaaagcaatataacctgtttctggaatcattccagtttgcctgcaagaattacaagggcaacacgaatgaagctgatattgcaaaagtaatggggtttgaatcgaatgatgaatataacgagattatgtttctccgggagatcacccacactgttaatgcctttaacgacatggcagatatcgtaaggctttattccaagaaaccggaaatggcagaacaaaggcttgaaaatcttttatcagaagttttgtatgaggattccgattcggtatagaacgacaaccggagttatgatatacttacacgcaagaagcatttcatcagttccgattgtctgatatcgaaaggagacacacgattatggcaaaaggatctgtaagaaaaaaaggaaagaaatggtactaccgcttctatgtagaagatgcaagcggcaatctggttcagaaagaatacgctggaacagaaagtaaaagtgaaacggaaaaactgctccgtcaggcaatggacgattacgaaagcaagaaattcattgcaaagtcggaaaatattacaattggagaattacttgatatatgggcagaggaagaattaaagaccggtacgctcagtaatgggacagtccagaattacctcggtgccattaccaacatcaagaagcatccaatttcagagagaaagttgaaaaatgtaacatctgagcatttacaagccttcttcaatctgctttcctttggtggcacttatccagatggttcagaaagaaaaggttatagcaaagattacattcgttctttctcggcagtattacagcagtcattccgatttgcagtatcaccaaagcaatatatcactttcaatccgatgcagtatattaagctgaaataccagacggatgaggttgacctgttttccgatgatgacatggatggcgatatacagccaattccacgagaggattatgaaagactgattgaatttctacagaattacaatccaccggcaatacttccaatccagatagcttattatgcaggacttcgtatcggtgaagcctgtggtctggcatggcaggacgtgaatcttgaagaacagtgccttacaatcagacgcagtatccgatatgatggttcaaggcacaagaatatcatcggaccaaccaaacgaaaaaaggtaaggattgttgattttggagatacactggcagagattcttcgcaatgcccgaaaggaacaacttaaaaaccgaatgcagtacggagaactttaccataaaaactactacagagaagtaaaagacaaaaacagagtttactatgagttctatcatctggacggaacagagaatgttccagaagattataaggaaatatcctttgtctgcttaagaccggatggaagtttggaactgccaagcacgttaggaactatttgtaggaagattgctcagaaactggatggatttgaaggatttcattttcaccagctgcgacacacctatacaagcaaccttctggcaaacggagcagcaccaaaggatgtgcaggaactgttaggacactcagatgtcagtaccacaatgaatgtctacgcccactccacgagaaaagccaaacgggaatccgcaaagttacttgataaagtggtaggcaacgactaaataaaactttcccttatttcccttacgattatctcataagggcaaaaataagggaaaatacatatcatttcactaatgaataggctaaaaagcctgtaaaatagggaaagttataaaaatatttcggcaaactggaatttgagtctctgtaaagctggaattaacccatacaattattttaatttagaggttcttacgcaattatccgtattttgtaatttttcaatactggaatgccagtgtaaatcagcattctccatttttattaaagcgaaaaacgtaaaattgcggaagaaccaatttagatattcacaattttacttgccacagtatctcgaaaaacactgtcatgttctaccaggagcatggtcggggcaaactccgttatgagttgttcaatctgcatacgtgagtacacatcaataaagttgagcggttcatcccatacatacaagtgtgccttttcacaaaggcttttcgcaattaggactttcttcttttgcccgccagaaaagtctttaatatccttttcaaactgtacacgctcaaagtccattttcctaagaattgccttgaacaaactttcatcaaggttgttttcttctgcaaactcggaaagggttccacataaatacgatgtatcctgtggcacataagaaattacaagcccagagccaagtgttactgtacccgtataatctatggactgcccgactaccaactttaacaggctacttttgccactgccgttctttccatcaagcacaatgcgttctccctgtcttatttcaaacgaaacgggttcacaaactgaaatgccatcataataaactactacattcgataatgatgcaagcaaatctgtatggtaattaagcggttgtatcttgagggcttctgcggtttccatatttttcagcaatgctgatttttgttcgattgtctgttgttgtctcgcttctatagattttgaacgcttcatcattttggcggctttatgaccgacataacctttatctgctgccccaattttggaagcttctacacgttcagaccatactgcagcgcgttttgccgactgctgtaatcgtctgatgtccttttgcaaacgttcgttctgagccagttcaaattcttgctgtcgctcaaaatttgacatccatgatgaaaagtttcctctttgcacttcgatattcgctcggttaatcgatagaatatagtcaacacaatcgtcaagaaagcgacgatcgtgagaaactaagatgaatccctttttctttttcagatatgccgccacactttttctcgctttggcatccaaatggttggtaggttcatcaatcagtaggaaatgcccttcattaagaaaaagagcggcaatcaaaacctttgtctgctctccgttggaaagtgtttcaaaaggtcgccaaagcacatcgacatcaacatcaagataagaaagttctcgcataagttcccattcttccgcaagtgggcaaatctcctgcaatatatcctctgtaatacgattcttatctgaaacgggataaggaaaataatcaaactgtacggatgataggatttttccactatactcatatttcccaagcagaagattcagaaaggttgttttacctcgtccgtttctgcccacaaaaccaagcttccaatcggtatcaacctggaaactgacattttcaaaaacattatcataacttgtcggatatgaaaacgtaaggttttcaattttaatcattgacataaatattatcctcctttgcatgtcatacgatacaaagtcggttcggtgaatgtttactacgtatagatttcaccaaaaggaaccgacactatacggagtgaatcatgtgtaactatctgttctgcactattcataaagcacctccaaaacaaaataagagccacaagaaagtttatccttgcagctcgtcatagcataaaataacaccactaagcaaaagtggcaacagcactatattgagtaagatagacatataactttcttgcaatagacacaataatgccaaagtatagcactaccgcatattttgattttatttgcaagaaaagttaatcatcttcccacctctttctaaatttcaaaatattataccataaatcgcaggcaaatacaagtggttataaaaatttaacaaatcgcttataatacaatcatataactttacgcattccttactgaccgtaaaattccgatttattgctgactttattatactttattgcctatcgaaaagatagcatattttatgaaacttgtcggctgggaacagcttgcaacgcaaggtgtccccagatgacaagtccacaaaagggtagctggcggtagccagcgcaggggaagcgtagcgtcccctgtatgatttggagcagaccatgactgcgaaaaatcacagccctccggcaaggagccttcggagaacgcaatgcaccaacctttgggtggtgtataattgcgcccttagtaaactaaggggtttccggcttctcacgttccagcagtttcttcaatagttcctgcgtgtcctgcctgtgaaaaatgagtgtcaacaacagcatgacatcatcatctgtcaggcgttccggctcttgcagaaaactttccagcataccgccacgagtacagagccggtgtgtccgttcttttcgggtaagctgctttagctggtgctgcaatgccttttcatcattgatggctttccgcagtttcttttcactcttttccaactctcggttgagcttttccagctttgaggtatcaggcaagggcagcgtcctcctttcccggtatcagcacataaatcctgtttggttctccaacgccctgacgcactcgcatgatcagtccggcggtttccagttcattcagagaacgcttgaccgtcatggggctgcgggacaggactgcggcaatggctgtgacagggaagcagataaacaggattccgttctcgtcctcctgtccgttggatagcatagcgtccaacatccggcagtacatgacctttgcggtgctgctgactggaaatcctgtcaacgctctgggaaagggcatacagggcggcaacggtgtgcctatcgtcataaattcaaaattcattcggtgtgttcctcctttttctttgctcttttggataaataacgggggcagtcaaccacaaccgcccggaagctctgcttgcacccatgcttgcatttccggcataattcgttgtaagtgacacgcccccggtcattgaggtaaaaagaaagctcatgcttcctctttttgctcattctcggcatattgcgtttcctcccgttttagtgtatagtttcggggcgattttcggcaaaattacggtcatagagccgtctaaaatctccagaagtatcagcaatagggtagactatccccctatcagattgtcgtgtttcggtatcatttcggtatcagttcgccagttctccccggtgtcgttcctcccctgaatctcacagcggcgtattgctccctttggtacgctcgtttcggtcagggttcctccatatccctgccaaaagtcatggcgctacatcgccggggaagcatatcccacacaggctggtcattcgattggaataatccatcgatgaactacctgtatcatagaacatttttgtgccctgtgccgtatgtccacaaagtaggaattcggggtaaaaatcagaaatttccacgattgcggaattgatatggtataatcaattcaacggttataaatgtcgtcagaagggggaactgcttcaatgaacggagctactacaatacaggaacggctaaaagatttacgattaaacaaaggattaaaactggaagaactggctgaacaaacgggtatttcaaaatcggctcttggcagttatgaaaaagatgactataaggaaatcaatcatggcaaccttatcctgctggcagatttttatggggtgtcccttgattatctcttttgccggacagagaaccgggcagagatcaacacgccattaagggagctgcatttgagtgatgagatggtagcacttctgaaaagcggtcggattaacaaccgtctgctctgtgagcttgccacccataaggactttatcaagtttcttgcggacattgagatttatgtggatgggattgccaccatgcagattcaaaacctcaacgcccttgtcgataccgtccggcatgaaatcattgaacggtatcgccccggcgaagatgacccgcatttgaaggtgctgcaagctgcccatatcagtgatgatgaatatttcagtcacatggtacgggatgacctcaatctcattatccgggatattcgggaagctcacaaaaaggacagtgaaagtgcgccccagaccaccgttgccgatgaactgaaagaaaatctggaagcggtcgaaaatttcaagggcagccgggatgaaaagctcgttgtactttactgcaaacagctcggcatcaactataaaaatctgtcagacgaagaatttcgctggctgattcggattctcaaaaaatcaaagaaaatgggaacgcctatcagccagaggaaaaaacggtaaaaaaaaccgctgttgcatggttggggtgccttccatgtagcagcggttcttgctgtggttattatttcattcgttttcttaatatccggcgataatttgtttctccctttggtgcgtcctgtataatttccaacacaccatcttcaagcattttatcaatgcgattagaaatccatacatcactaattccaagttgatattttcctaaaacattacctataacaatagccattttgaattgctctggctgttccgcaatttcacgaagaatgaaactatcatatatatcttctgaaacactttgcaatttaccatttagcattgcacgcaaaggtgcattttcattttgaagttgattccatttcatagcacaagctgaaagaaatacaggcttagctttttcttgtagagttatatattttccccattcgccaggagaaacctcaccccatgctattttggatgtcatagtattttcttttccatattcccaggcaggtaacttaaccaaataaattgttgtctgacagtttaatggtcgaagttgtttcataagccagtacataccgcaaagttcatccggattatagctataccaaatacgaacttcttccccagctacatatcgttcaataaccgaagacaatgtagttttaattttctgtattttttcttcaacctgatagtctaaatcctctacaaaccagacagacagcattttcttgagaacatttttccgctgttcgccaattccattatcagaaatatctcccacactaagagccatatcaaaacaataaacatcactgctcttgcctcccaatggaatagcattctcccaagcaatatgttcttgttcctgtgcttgaatttgtgcttctttcatttcatctgaagatggaacactcccatcttcgtgcctcataaagaccgaaactgcacttcctctatactttcccttaccgtaagtttgggcaattttcaaacttccacaggcactttcaccaaatacaatttcaatcatcttatatacctccgatttaattactcccgtatgaataaattatatcatgcaaaacaatttcttctgcccggttgtgaatgttattacaacgctgcacccattccatttgttgagttcgcttcaattcctctgtcacgccctcggtggctttcatctgctccatgatagtgtctaaccgttcctgtgcctgttcgttcaggtctgcaagatatgtccacaattctccggtcagtatcaatgtattcaatctggctgggtggacttcccttaaatattcccggtgcatccgtccgtactttccgatagggcggtgttcctccggcagtttcaagtccgggatgtagtaatctccgacaaggatataatcaattccgttttccgttattcttggtttcaattctctcatgttccttacctcctgtggaagcaggctcgtctggtactaactcaatcacatcggtaatctcacaattcagcgtttcgcagatacgggctaatgtatccatgctgatgtgctttccctctttgctcatgttggcaatcatatttgttgtcataccagcagcaagccttaaatcctctttcctcatatcacgctctaacagtgtgtgccagagtggtttatagctgatgtgcatattgttttcctgcctttctatccataccaccggggcggctgccccggcaggaacttttctcttattatagcaccaatcttgtgaaatcacaatttattcttgtatcctgccgctgataccgtctggattggttttcctttcttttttgttccctttaattagccatgaactgcttcatgccctgagattttactgatgtgtgataaagaagtaatagaagtgtaaagaattttgccgttcctatccggcacatgaggtatgtcggataggtcgggcggttattcgggcaagtccaccttgccaacaaaagaataataaatctcaatgtcctgcctacgggtcttgttctcgtcatagctgcactcatgcacaacgattttctctacaaactcccgcaacagagtaggggtaagttcttcaaagctggtatgccgccgaacaacattcataaacttttctgcgttcacggtggcttcctgtgctttggaaagctccgcttggatagcagcggctctttctttcagctcccgttgttctgcttcatagtctgccgacagctctgtgaaacgctcgtctgatatgcgcccggtcacgctgtcctcatacagccgcttgaaaatagcggataactcggctatgcgtttctcggtggcttccagctcctttttcttggcggcgttcctgcgcttgcccccgtcctcgttctgctcaatcaagagcttcataaaccgggcttcatgctttgccgcatagcttgtcactttccgcagattggagagtacgccagcggtcaagaggtcggtgcggataaagtgcgccgtacagtcatgggtgcgtttcttgtagttgccgcagatataacagtcctgcttgcgcttgtccgtctggtatcgctgctgatacatgacactaccgcagtccgcacagaacagtatgccggagaacaagcccacttcatcatagcggtttgggcgtttgcgctgtttgcgaagctcctgcacccgttcccatgtttgggtgtctatgataggctcgtggtggttctcgaaaatcacttgcttttccgggggattttctacactgtgcttgactttgtaagaaagtttttctgtcttgaaatttaccagacagcctgtgtattcccggttttcaaggatatgcactacggtattggtcgcccacttgcactcatagccggggtggtagcggcgggtgctgcccgtcctgcggtattcaagcgttcccggcgtggggatttgctgctctgtgagcatacgggctatcttggtcggaccattcccggcaagacagaggttgtatatctgcttgactacgggtgcagcttcctcgtcaatgatgaaattttcgtcctcgtccatgaggtagccatacacaggcttgcttgtgatgggcttgccactcatgccttttgagcgttttaccgcccgtattttcttgctcgtatctctcaccagccattcgttaaagatattccgcagcggggcaaagtcattgtcgccctgtgcgctgtccactccgtcattgatagcgatgaagcggacgcctttctgtgggaaaatcatttccgtgtacattcccacttgcaggtagtttcgccctaacctcgacatatcctttacgataactgtcccgacttttccggcttcaatgtccgcaagcatggcttgaaaaccgggtctttgaaagttcgcaccagaataaccgtcgtccgtgtaccagcgcagattggaaaagccgttctgcttcgcataggtttcaaggatacgcttctgattggaaatggaattgctctcgccttgcagctcgtcctcatgggaaagtcttgggtaaagggcggtaattggttgttggttggtctgtcttaacataaaatcctccgtttccgacagccagccccactattccgtaccttgattgtaccacatggggtggctgtctgtatagcggcaaaagcgtcaaatctgcttctttatggtcggtcaaatcgccattttttgtgtagcagcttccgcttccagcactttcatcatcttgtcggctgcggtatcggttgcgccctgcttgaagaagccggaaacggtaaggacggagttgcccatgcggatttccgtcacacagtccgggcggcggtctgttttggtggtgcttgtctgtttcgtttctgtcataggctctcctttcgctgcttcatcagttgctttaagcgttccagcttttcctgtgcggtttcctttcggaagttgctgcccgtgaagcggacgggggcgcacatggaagtcagcctgtcatagatacgggcgtggggcgtgtcctgcgggtgctgcaattcctccagcgtgaggttggtcgtggcgatcagcggcttgccgcttcggtaacggctgtcaatcacgctgtaaacctgttccagcccgtactctgtccctcgctccataccgaaatcatcaagtatcagtagaggatagctgcaaaggctggaaatatattcgttcctgccctcaaagctggcggcaaggtcacccagtatcgttgcaaagtttgtcatgcagacggcaacttctttctccataagggcgttggcgatacaggcagcgaggtagctttttcctgtccccacgccgccccaaaacaggtagccgatattttcagcctgcatggtttcccagctctccacataaaagcgggcggtttcggtctgtgggtttctgccgttgtcatgctcaaatgtccagttttgcatagcggggtcggtaaagccccggcgtttcaagtcctccactttttcaaggtgcttctgtcggctttcagcggcttcccgtttttcacgggctgcccggtggcagtcgcactctgccgggtgtcggtcatgccctaaccattgggcggtttcttttgaaaaataggcttctttgggcgtatggcacttgccgcagtataaaagcccgtcctcgcctgtgtagtcctccgcttcggcggtagtggctgtaatgtccgtaatcatagcttcaatctcgtttttcataagctctcgccctccttgcatgaataatcgggtatgccctgtttcggggcagccttgcctttggcagcgtcctcctgcgcccacttgtaaatggtggctgcatggctgtggtactgcttcccggtggaagcgatatggcaggaaagccggtcaatataatactcccacttgtcgggcagctctgttttcagcccggaaagctctgtatcggtcagtatcacattgttgtatctgccataagcggcgggggcggggtgccccgtttttccctctctctctttttctatctctatctctttctctaactctatctctatctctggtggacgaatgtcggacaaatgtccgccttttgtccggggcggtaaaagtgccttgttttccagccttgcagcccgttttcgctcggcttcggtagaggactgtcctatcatcagctcaatgtcggtcatatagaaagccccgctgtcaagctgctccacaagccccaactgccggaaaatctctaaagccctctcaactgtccctatctggtggcgggtcagtgtcgctatcatctgtgctgtgtaggggatatgctcgtcaagctgcaatttcccgccgtttttcagcgattttaagtacagcttcaagaggatattggaatataaaatcccgtctttcatatcttccagcagcacaatggagtcgctgtcaaaaagttctctttcagcttgaggtagtaatacttgcggttatctgccattgtccctgtcctcctttttccggcgtttggagtagtagcgggggcagagtatgataaccgcccggaagctctgcttgcagctatgggtacagccccggcagaggtcgttgtatgtgatacggtcgcaggtggtattcccgacttttacttgccgcaggaaaaaagaccattccagccgccgtttcttgctcattcttggcatgggtgcgctcctttctgccgtttccgctggtgtggcggtatcggcgataattctgtatcatctcggtatcattttcgggatttttctgccctgtaagcccgttaaaaaatcctttggtattgccggatagggtacggggcagcccccttgttcggtatgggttcgggtacattttggggtggtttttatcgctcctgttcctgccttttcacaggcttgcgttcccggcgtaaaatctggtcgatattgcccttgacagtctgtaagcggcggtattcctcccgttttgcccggtaatcgttgtagccgctgtttttctctttgataaggctttcaatctctgcttgcagggctttatggctcggcagcttggaaatgccgttctccctgaaatagcgggcggctgcgtctgctatgataaagtcgctttcgtgcttctgtcggtaggctgcttttgctttggcgtttttctgctgtttcagcccgtcccggacagggcgggtcttggaataggcaagcacctgccgttgcagctcctttttcccgtccagcgtcttttccacctgcttcagctccgtaaggctttctcgcatggcggtataggcggcagaacaggcttcgtccagttcctccggggaagaaaagccgtactgctggtaggcggtaacggtagccgccatttgctttagattgtgctttgccgcccagcggtcatagcccacgcccttgccctcggctcgcttggcttcccggtcaaccatgcgctgcaaggtgttgtctgccggggtggtttttgtggttttttccccttgtgacggctttttaactgcgacagggtattcgggtatggctttggtctgttctgcggctctgcgggcgttctgtgtaagcagggcaaggacagcagccttgtcaaaatcgtcccccagcttccgggctgtgataggctttgtcctgtccggcgtgaggtaggaaagccgcccccggctctccttgacggtcacaccctcccgcagcaaaagggaagaaaactcgtcaaagctaccagcttgggaaagtgcctgccgtatcgtccggcgcagcttcgccttgtccgtttcaaacttggtgggcttggttggctgtccggtggcttctctggcggcgttctctttatcaagggcaagctgccctttctttgccgcccagtattcccgttccgttatccgttccttgctgccgcttaggaggtcgatttggtaaagcccctcccggtggcacatctccatgacttcactcttgaaatattccatagcggcgttggtgcagcggtgcttgcagccctcccgtgtatcggctggtctgtccatgtagggcagaagcgggacttcataaatccgcagggagttgatgacgatatgcacatggatattgccgctgtggttatgcccgtccgggtgggtgcagattagggcttggtgtccggggaaatgtgccttgcagaactgctcgcccaactcctgcgcccggtctacggtcaagccgttgtctgtcccgtcccgtgggtcaaagcttatgatatagtggtggcttttcacatcttcccgtttttggtttttctcatagcggagattagcccgcatacaggcaacagcgaaatcctcgcccccgcagttaagggaagaaatgcggtaatcctccctcggtatcagccgcccgttttcatcaagggtgggcttcatggtaaactcgtcatgctcaaatgtgaggtaggcttccgctgcgccatagtctgcatttttagagctgatatgtttgaatgttgccaaccgcgtcacccactttctgcaagatttcaaactttagggcagcaaggtcggaaaccgccgcccgtacctccccggcaagctgcgggtaggggctgtgccactcgttcagcgtccgggctatctggtttaagttgccgccgatcctgccgtattcggcggtcagcttcccaacagcggcaagcagctcgtcattgacgggggaaacagttatgatggggcgtatggctgccccggttatggcttgccggataaactcggattggctcatgttgcaggcagaaagcctttccgcaaactcggcatattcttcctcggtcatgcgtgtcttgactacccggctgcggtgcggtgtgttgtatcgttttcgcatggtaaaacctcctttcgactgccgcatggctgcggcgggataagcggcgtaagccgcatggcagggtttggggaaggcactccccaacaagattcccgcaggggcaaaatgagcgataagcgaattttggtactgcggtagaatcttgctctccgtgactgcaaactttctctcacttccgtccgccacttttttggaaaactgcaaccacaaaagtttgtttctctttttctgctactactaatcctgtaaagggcattcctgcccgctttcgctaaaatgacaccggacgcagtggtttctacccggtgttggagaaatcctttctctttgccctctactacgggtaaatgctccaaatgccaaacaccagggcagaaaaattccctcctcgcttactactacaaccggcagggggcaaaatggccgggagcggagccggacaacaaaaaaagcagtaaatctttttcaagacttactgctttcgctggccgcgtcggtggcggctggtattcagtttttatgacttgtccggtggttcgtcaagccggaacttgaattgacagtcaattaaccgctgctttacatagtcctccacctcggcgttgacctgcccgttcacttttgagaaatagcggatatatccggcgtagtggagcaggacagcgttcacggcttctgggtcgccctcacgggctttgaggattgtttcataggggagaagtctactcataccggctcacccccatttcttcgcgtagccgctgcaaggcaagctggatatgccgccccgctgtgctgcgtgaccggccaatacacgcgccgatcacgcgctgcggctggcgcagaaagtaatagcgcaggatttcttcccgcgtctgctccggcaaaacagagatcgcgtcggcaagggcggcgttgcagagcaggacggtctgaccgcagacggtaaatgggtattcctcgtccggctccggcgcggcaaactggacaaacttctcgttcatcagatagtcaagggaaacttgccgttcccattgccgtttaagcttcaaaatcttgtccaaggcggcacagcggataacagtcttgcaaaaggcgttgtacctgcgctggatatattcttgataggctatctggtcggtcatggaaattcccctttctgaataatagtgcggggcggtggcacttcttgctgtcgccccttgattgcctaccagcaaaggcgggcggggctgtcaacgacggcgcatatgcgccgttcatcttgaccgttgactggctcggctgggtttgctatttacccgacaaacttgaatttattttaagctatcacgttttaccttcttaagccttactatcattaccataggaatttctttgttggttttaaaacattcttcataaaatccatcaatgacaaatccagctctaaaacaaaggttaaaaatatcttgtatggaacgatgataataaatctgctctttcggttgcccttcaatcgctatatcatagtaactgtgcggtgtcatatatttttcagtcaacgtgacaaaacaagggtgttgcgttgcaaagacaaaaattccgctttcctgcaacagttcataaacagccataagaagtggttcaatatccgtaatatccataattgccatattagaaactgctttcgtaaaggctcgatttctttttaattctaatatactttttctatcggtcgcatccgccacacaaaattcaatttgttttgcatattgtgattgccgtcttttagccaattctatcatttttttgctgtaatcaaaagcgacaaccgaagcgcctctttgtgcaagatacgaagaataatttccattgccacacgcaatatccaaaatgtaatccgcaggattaggagatagaagttccgttactttgggacgcactacctctctgtgaaattcattagattcgtcacccattgcattatcccaaaattgtgcgttctcctcccagatttttttactttcctctgttcccatgttctctcccactccccaaatttgcttttttgcttccattaaatcttccttactatattccattgttaccctccataacttctgattgttgccgtcttgacgattatgtatctttacattaccttctgaaacatatggcgcaccttgtccaggcggctgtttggacggcggggctggatgaccggctgaccgacagcggcctgatatcctttcagctctgtaaggcatacgctccgcccgttggtgtaaaaggccagatcagtacggtatgcctgtatacagcgggcgggaatctcgccagtaaagacaacttcatccttttttacctgggccgtttcgatggtggcacagtatttcggtgcatcatgataagccctggaaaggtattcctggggcgcatagaggatgaaggagagataaggttccagcagctgcgtccccgattccttcaatgcctgttccaatacaatcggggccaatgagcggaagtccgccggcgtgctgaccggactgtaataaagcccgtattcaaagcaaatcttacagtccgttacgttccagccgaacaagccctgctccagcccgtaacggataccatccctgacagcgttttgaaaactctggttcaagtatcccagcgaaacccggctctcgtattgtacaccggagccaagcgagagtggtgtaacagacagtcctatggatgcccaaaacgggttgggcggcacctcgatatggatggtgtggctggctgctttgagcggccgctccatataaatgacggagggttcctttaccactgtttcaagcttgtatttttccgacagcaaagcggaaacaacctccaactgcacccggcccaaaaaagaaagaatgatctcatgggtgatggaatccacttcgcaacgcaaaagcgggtcagtatccgcaagttgcgtaagagcgtccagcagccgttctctttgcgctgccgttttcggcgcaatcgtcgtccgcagcatggggagggggtcctcgcgccaccttttacgagggagccgggtttggtcccctaatacatcgtttaacctcacgctgtcgctgggaaggataacaatttcaccctgataagcggtgtctgtccgaacaatttcccctttggatggaatacgcatctctgtgattttcagcttttctctcccggccagggccaccgtatcccgcaggcgcagcgttccgctgtataaccgtagatagacacgccgctggccgcaatcggtgtactcaaccttgaaaacgctgccgcatagggcggcgcccccctgttccccaatcggttggaacagccctgtcaccgcatccatcaacggttgaatgccaaggccatttttggcgctgccatgatagactgggaacagggaggcgtcttgaacccgctgctgttcctcccgcgcaagttttttccggctgattggttctcctgcgatatacttttccaataattcatcgttattttcgatgaccgcatcccatgcttctatgtcggtattttcctccaggactatttccggggacagcgacaccgtctgcttgatgataatatcggcggagagcttatcccgaacagactgaaccacgctctgcaaatcaacgccagcctggtcgatcttgttgataaagataacggtgggaatgttcattttccgcagggcatggaacagaatacgggtctgggcctgcacgccatctttagcggagatcaccaagatggccccatctaaaacagccaaagagcggtacacctccgccaaaaaatccatgtggccgggcgtatccacaatgttaactttacatctgtgccactggaaggaagtgactgccgcttgaatggtaatcccacgctgccgctccaaaaacatggtgtccgtcctcgttgtccctttttcgacgctccccggttctgaaatggctccgctggcatatagcaggctctccgtcaaggtcgtctttccagcgtctacatgggcaagaattccaatattgattattttcatgtgattgtcctccctttacagccccaaagggcataaaaatccccagcagtaaaatacttttaccactggggattataagttgcggacatacacatatacagcatacacctgtttgtgattgctgtttttggggatatgtcaaaattgataaggcaaaagtattcttaaattgggtacaaaaaactaagcccctacaaaaggagctatcataatcctttgttcccactatttgattatagttttatttaagaataccttgccgcatattttttactccttttctggattaaatcattgtatcacatcagttttaggaaagcaagtacctaaaagaaatttttcttccccttatatgtaacaatcataccggcttcctagcgttcagaatgttttctgctgtctgctgtggtgtttggttggaattgtccagccaaaagccgatccgtggtgttgtctgcattttactaaatacaaattcaatgtatacagaaagatataaggagtgggagggattccgccgtagttggcattgtaggaaaatccaaaagtttagattttcccacaatgcttatcttttggtctttggttcggaatagtgtagtgctggcggtctatctcttgttttcggttgcttgcttccttaccgtacatgagcattggcgccagggttgtcgttgccgtaaccttccaacaggttgatgacaccccagataccaagaccagcgcccagagcgataacgagagtctgaagaacggtaattgcctgttcaaaaaatgccataaataatattagccggaatcatttgaatgattagttaggtttgtttcataagcgcacaaaagccggaacaatctgccctcgatatatgagagcctgattccggctgtcctcctttttcattattttgttgatgattgcccgctttgtacgccaatggcctcaacagaggcagttgcggcaaatagatacgatcactcctttctcagcggaaccgtattacacgccctccgtgtctacttcatatacatcgcagacctcatcaggcttgagttttagtctggcagacaaaaatgcttcaatatcaaaggtatttcgcttgtctgcatcagctgtgtatttgaaattagggtgtctggtaatgtcatacttgtctgaaagaaacggacgcacaccgcgcaactgcaagatgcacttgccgccatccataactgccagctcgtcctggctcatcagctcttttcccaatttctgataattgagcgagtgggaggtctcccgtccccggctctctccggtgttgtaagtgtctatggtttcctttcccagaacagccgccagctctttcagcgttgttggctctttgccacccaggaagatggaagtatccatattgccgatgatggtatcggcattatctttgtaaattgccttgagctggctctgtgcctgcaacaccagacaggcagagatttcacggcttcggatggtggccaccagcttttccagcttcggaatctgcccgatgttagcacactcatcaatcaaacagcgcacatgaaccggaagcctgccgccatacacatcatcggccttttcacaaagcaggttgaataactgggtgtagcacatggaaatgagaaagttaaaactgtcatccgtatcactcataatgaggaacagagccgtttttctgtctcccagcgtatccagttccaactcatcgtaggatgtaacctcgcgcagctccgcaatatcaaatacggccagacgcgcaccgcaggaaatcaaaatcgacttagcggtttttccagagacgaaaagtcaaggactttttcatcaaattcacaaagaagtcacattttgcggacttcctcacggagcatacgcttgattttgtcctccatcgtctccttggcggtctcgctgaaatggacacggacgatataggttgtcttgccaatctgctttctgacagtagggcaagtggtgctgttggttgcggtattgttcattcaaaatcctcctgtaaatgaaaaatgcccggtgactgttcatcatcgggcggtgtcggtatgagggaacaaggcaaggcggcaacattaaggtatctataaaaaccttgccgtctttgccatgcttgccgtgttcctgcgtcagcttcggagatagcagacccatgctgtgccgtctttctcggtcacaagcctgtctccaatacggcttttagctgtcctcatcgtgcgtgaggatatgcccctgtcattgaccgctttttccagctctgcactcggcattttctttccgtctgccagcagttccagtatcagcatttctgcctgtgcggtcttactttccgtcttggcggtgtctgtcccggtaagaagctcgtcagcggtaatgtcataagcccctatccactcaaagcctttctcgtctcccagagaaaatgcaagggactgtccgggcggcgcaagggagcttttctcatggataagcaccctcgttgtagggctgtccttcagcttgccgataaaaagcagactgcggactgccgccgtaatgtcgatagaccccaatccccggtaggtgctttgcgttcctgcggctttgttcaggtgtccaatcagcacgatagcgcacccggtagcctgtgcaatgtctcccagactgcggaatatcgggcgcacctcgtttgctctgttcatgtccacatctgcgcccagaaacgcctgtaccgggtcaatgataaccagccttgcgttgttttcccggattgcccttgctatgcgctcatcggcaagggtcagcggtgtgtccctatcgtcaatgacaagcactctttcaaggtctgcttccgctttcatcagtcggggcttgacggtatcgcccagaccgtcctctgcggtctggtagatgatgttgaaaggctcaagggtctccataccgggtaaaggctttcggttggtgcaagccgccgcaagacgcatggcaaagtaggtcttgccctcgccggggttgccctgtataatcgtcagctttccaaaggggatatagggaaaccatagccaatccacgctcgtcagctccacatctgccatgcggagcatgggaacaggctgggcggtgggcagctctcgcagcgtgattgtctcggctatgaatttgcggctgggaatgtccccttgctgacggagaacatcgttccagtctttccttgccgggacaaggcgaatgacggcgatctcgccgggaatgtcctgtgccagccgggtgcaggcttcacttcctgcggtgtcgctgtcaaggcagaggaacacttttcgggtgtccttgcgttcagaaagaaaacggtcaagggctttgcctgaaacgccgcccagggcaaggtagctccttgcctgccagtcctgcggataaaggcagataaaggacaaaaggtcaatcggtgcttcaaagacaaagagctggttgccgtttccctcatagtggaacggataggatttgtcagacccggcaatgtcctgtctgaatgggtctgccgttcctcgcacatgggcgtatctcggcgtaccgcttcggtctctgccgacaaacacaacattgtgccgctttgcgtcctcgtaaatatccccggaaagaagaaaagcctcaacaagcgttttgttgagacctcggctttcgcaaagatattgaattgctctgtcggctgttctgttgtgcaagggcaagtgaaacgctgtgggcggtgctgtgctggcttcgctctgtccctcggcgctttcgccggttaagagctggactgcttcgggaaaggacttgccgtaaaactccatgacaaaatcaatgggatagccgcccttgctctggctgtggcgaaaccatttgtttccccggacggtcaggctgtcatgttctttccagcggtattcccgtccgcttttgataagtgtctctccctgtgtgcggagaaaatcttccagactgacggcgttcgcccggtcaatctgtgcttgggtgtaattcatcgggatagttcctcctttttgtgtcgtgtttggggtcgattttggtgcatttgttcctctgtacgctcgttaaatcgggcggcagtatctacacatgacttgaccttccaaagacggtgtaaatcgtctctgacggtcttaaactcgccataggtggtttcgtgcgcctgttccagctcgtcatactcttcggtcagctttttcatatccaccttgccgtccgggaactctccggtcagcttgcgtctggcggcgtagaactgtttcagtttcgcttcatgctctgccttgtacttggctctgggcttctcaaacttgattttctgcaagccgtcatagacaggcttcaagctctggaaagcagcggagctgtcatagagctgcttaattgctttcattcgggcggtctgttcgtccagcgttttcttcaagctctctgtggcagcactgtgttcgctgacacggtgttccaaatcttcaagggagtaaatgccgtttgcccggagataattgaaagtctcgttcatctcctttaggttgctgaccttgcctttctgcgaatatgccccggctctgcgctgggtgtaataggcgttcagcagagaaacaaggtcgggtgcctgcggcttggcaagctccgcttttgcttcggcaatccaatcaaacaggagagcgattttcttcttgatgtcccggataacggcattggttgctctgatccagcggttgaactcgcctttctcggtgcgtatgcctttcttctccattgcccggacggttgcgccctcatggacggtgggaagaagctctacgccctgacgctcatagcttcggtggtcgatacgaacgtcaagccccttttccgcaaacttggcgttgcataactctgcccatgtctgccgccagtattccagcgtttcgggactgccccagtcggtagtgggaacggcgttgaaaacaaactcgccgttctggtcccggatacggttgccgtcctcgtccagctcatacacccggcgttgctttagcccccatttgccgttctgctcgatggggcggatagggcaaagcacatgaaaatgtggatttggtatgccaccgtcctcccggtctggctggtgtacggcgaagtcaaccaccatgccccggctcacaaagttctccaataaaaattgccttgcaagagcgatgttttcctcaagggaaaattcattctgcaaggcaatgtcaaagctgtatgcaagctgggcgttctttccacgctcggctttttccacggcgttccatagggtctggcggtctgcgtattcgggcggtgcatgggacggcaggagaatgtcggagcagatcacgccgcccttgtgggtgtagtcgctgtattcgccgtaatactcgctatacaatcgctccccggctcggtaggcggcagaagcgatagcggactgtcctgcgcttcgcttagtctgcgtgacgctcagatgaaatagtgccatcggctttcaactccttttctctgtttgcttggctgatatgagtaatcgccatgtgacggacggctcgctggacttcggacagggaaaagatgtgttccatcagctctgtcatttcggtgcgtgtgagatctttgacctccggggcaaggctctcaatcgtgccgcccagattgcaaaggcggtgggtgcgcttggtgcgttcgcctttctccagatacttctttctgttctccagacgctccagcttgtgttgttcctgtgcaagctgcgtctcggctcgttccttttcggctcggagctggtcaagggttttcggttttgtcattgtgattgacctccttttttgattttggggataaaaaaagaccgtcaacttttcgcatagtgcgaccagtcaacggtctgattttcggtatttatttttccaaacttgctggcggcgaacagcattttatgctgtttgcggacggcaagtccacaggggatagccgcattagcggcgcaagggggtgtagccaccttgacggaacgaagtgacgcaactttctcggtcgggcagttttcttctgctgacagagaatgaagctccgcaggacgcacatactcccgataggagagtatagaagtgcgccctttagttcctaaagggattttcttctgacccaaattatataaaatgtagatcaagacatttctaagaggtactctcagattttcacaacataaggttcatcttcaataataccctgatcgtgggtaacaatgataaccgttttaccttcttcattgagttcgtgcaataacctcataacaatatctctatttttcttgtcaagtgagccagtaggttcatctgccaaaacaacagaacattttttcatcataagacgagctaaagcaactctctgttgttcaccaccggaaagctgataaacttttttgttaacttcctttgataaccccacacgattaagagcttctttaagtgatactttagttcggcttgattttttaatcaaacttaaattttctttaactgtcttattttcaagcagtgcaaaattctgaaaaagaaaccccactgtatccgcaaaaaaactgtttttatttttaagccgggtaatattcagcccttcgattatgatactgccgctatccggtttttcgataccaccaatcatattgagtaaagtgctttttccactgccgctatcgccgctgattactacaaaacttccatccggaatttctaaattaaagttagagaaaattattttctctccaaatgctttatttaagccacgaattataatcataaacatcctcccttcaatgactttgagatatttgttttttcaacccacataatatttgtgaaaatgattgccatttcaataatggtgagcaacgctccaatcagtaaagcaatcccgacacttgcgttagatataaaaatcgaaacaatgcaaatcaatatcacaacggctatattttctaagagattaacggaaataaatcttttgtgcctttcataaaagcgatagcccaaaacctttttgagggagatttccatcgcattaagtctaaattccattttcacttcagatatgatgatagcgatatctaacagcaatactaatacgcaaagagagcttataaagccaatcagtttcacgaggaaactatgactataaatgtaatcctctccgacattcgtcagcataaaatagtgtgaaccaagctgttctgaatattttttcgcaacactgcgaattgtgctttcatcgcatccgtagattacctcaccattatatgttcctgtttcgatataacttccatttaaagcaacagcctcatttgcctgataaatcacaatcggatttgttactcttgacaatccgtcaatagcctcttctctgttcgaattgagataataaaattgttctctgccagaatattctttataaacaacacgcagttcttctgcattttgggtaagagagccaatttcctcttttgcgatatctttgtatgattccgcatttcttccctttggcacgaagaccacgatatcctctttttcatcatcttcagtaagcatatcagaaaacccttgtagcatatctctggcattatgatttacaaaaatataattatccgtatcgcttatccggctgcctatgcagaccaccggatttatcgtgttgtattcattttcgtaaaggtcattccaaaatttgctctctttggattcctcctcattttcttcaaaaggaggttcaatctgcataactccaaaataataatcattataatgattttctaaaagagtagtgtttgtaagtaaattaccttgaatgctactgagatttgtagttattgtaaaaattgtcatggcagtagcaaatactttaagaccgttcagaagataaaacataccttttttatctgaagcattggcaaaggctttttttacatcaaagcggacaaaagcagcataaggaattacggaaagaactgctccggcacaatacactgccaaaatgagatgatcttcatacgctcccgatataaattgagaaacaagcaactttgctaagacgaataatgcagcatatgaaatcatatcagccactacagcttttagagcaatcacagcagcattttcgcccagagaagctcgtacaactacttccttttgcctgcgtatcacctcaatcatattaagtacaatcatcaatatggcaaccaggccccaaacaatgaacatcatatcagtttcggttgattgccaaaactctggctgcgatatagaatattcttttgccaaatcttgatatgtggcaataatgtcatcatcatcaccgatatagctgaccattatttcctgtccattgcctgtgttttttgcttctctaaaatcttcaaattctattacggtgattccacctatcaaagccgtatatgttttttcctcaatatccattgtgcttttaagactatcccgaacaacggtatcatcaccataaatataaagtcttgtctgataattagaaactctctgattaaaagtcgaaaaaatatgaacaccatgcttctcagctgtatcttctgcattggctaaaaatgaatccatatcgtcattagtagttgtgtatctggacgataaataataagcaccattaaagttccagagcatattttgatatacttcagcttgcataacaaaagcaaaaataatcgtaatcaacagcaatatatttcttatatgtttcatttgaaattcttaaacctcctttgaataggtaacagacacacgattgcccaaaatactaatatggattttttcatacaaccacattctcttgttagattctaattttccgttttctttattcgcataaattgtaccataaaactcgtgaacaattctaccgcaactttggactacatgagaaaagtccgaacagttttctgcccggacttcctcgctcaatcataaatcaattccgctttcacaatctcctctgcctgtgccttgcaagcgttcatctgccgcacccattccatttggtttttggcttttagttgctcggtcacgccgttttgctctgccagtgaccgcacgatcagctccatgcggtttcgtgccgcttcgtcaatctcggcgcaatgctcaaagagcttgtcggatagcaccagctcattgaacagtatcggacggtgcatttccagatacgccttgcgaagtctgccgtagtgtccgaggggcttggtcttgcggataacgatgttcgggataagataatcgccgttctgtgtataagtgatattcatgctgtttgtactcctttcatcggctctctctgcggtaaactgctgacagggacgaacactccctttgcaatatcctccgcacgaatagcggctttcttggcttcgatttctgccttttttctccccttgattttgtcctcgtatcgcttctgcgctccgctggctttacgcttcaagtagttctgatgaagcctgtccttgcgttcctcacgtttgcggatttcctctaattcttccggggtcagctccacttctccaaacgccgggggaacaaatcgcccgacaaaattgaagtaaatctcgacctcctgtgtggtctgtatactgcctttgcggtcacgctcatgcacaaggattttctcgataaactcgttgagcatagcaatggtcagcttgtcgaagttctcgtatttgtcaatcagagcgataaaacggtcagcgtccttttcgtgcttctcgtagctcttgactgccttttccagagcagagatttcagcggtaagctcggtctgctccttttcgtattgagcgtccagagtggcgtatctgctgtcggacagctttcctaaaatgttgtcctcatagattttacagagcaggacttccagctccgacactctctgctttgcggtggcaaggcgtatccgctgtttcttaacctctgctgtctgctggctggactgcgcttcctgcaccacacggacaaactcggctcggtcatgcttcgcatactcggcaatggctttgagcatttcagagacaagggacagtaccacatcttcattgatacggtgctgggtcttgcagagctttccaactgggactttgctgtattgggaacaggtatattgagaaatacgcttgccgttgttggtacggtggacatacatcttgccgccgcaatcggcacaataaagcaagcctgtgaggggagctgcttcgccccagccgtccgggtagcgtctgacattcccacggattttctgcacaaggtcaaaggtctgctggtcaatgataggctcatgggtattctcgaaaattgtccattcgtcctccgggacataatggcttttcttgtccttgaagtgctttcgggtcttgaaattgatggtgtgtcccagatattcacgcttttcaagaatgttgcagatggtggaagaaccccagccgtacacatctttgaaagtcttgtttttgttcacgccctcgccgtgttgggcaaggtaagcagacggaataagcaccttttccgatttcagtttgctggcgatctgatacggaccgtagccgtcaatcgtcatggcaaagatgcgcttgaccacatcagcggcttcggggtcaaccaaccattggtctctggcttcgttccagagatagccgtaaatgaccgtgcctgtgaggtgcttgccggacttgccttttgactggaaagtggaacggattttacggctggtgtctctggcgtaatactcgttcataatgttgcggaaaggggtaaaatcatcgtcccctttggcactgtccacgccgtcattgatggcgataaggcgaacgccacgctgacgcaggatttccataatctgaccgactttcagatagtcacgccccatgcggctcatgtccttgatacacaggtactccacattcccggcttccacttctttcatcattgctaaaaatccgggacggtcaaagcaagtaccactaatgccatcgtccgtgaaatggacaatgtttgtaaagccctgccgggcggcgaactcctccaacatagctttttggaaagagatttgtcaagggtgttttaccattcagcaacgaattaaggcataaacaatatcacatttttataatgctttttgaccacaatcagtccggcactgattgtggtctttattttggaaatgacattttccccttaaataaaggaatcaatcgtcgttgcgtttttcgtcaatatctgccataataaaaagaagtgtaaataaaagaaaaaggggggaattgccatgccgcaaacaccgtttcatgcctattacaaggcccgacttttggaacaactgccggaagcagaacagttccttccggtctttgcatcatcggatattgaaatctatccgtttcagattgcagcggccagctttgccctgcgttccccctatcagaaaggtgccgttctgtgcgatgaagcaggtatgggcaagagccacgaggccatgctggtcatcaatcaaaagtggctggagggatacagccggattctgttggtcattcccaatgccgacctgctgcaccagtggacggaaatgctggagcgattctataccgtcccatatgtggtgctgaccaatcgggaccaatggcggcagaacaccagtgaggacaactccaacgcttttatccaagatgccattgttattactacctacgacttcgccgccgacaatgaggaggccgcaaaggtagttaactgggatctgacggtattcgaggaagccaatgccctctctccagtctaccgggaggacaacaagcaggccaaggccctcaagcggatcgccggagactccttcaagctgctgctgaccggcactcccattgaaaagaacatcatggacttatacggtctgatctggttcatcgacgaaacgctgctgccgggagaaaaagagtttctggcccggtatctgcgccgaccagagaactacccggaactcagcgaacaggtcagccgctattgtttccgtaccctccgttcccaggccaagcactacgccaaggtgacggaacgtgtgctgctgaccgtggagtacacccccggcaaggcagagcggcagctctatgagctgctgtacgcctacatcaaccagccggaaaagcgagcctttcccgaaatgaaccaatatgacctggctctgcggctgctgggcctgttgggttcctctacggcggcaattttgcaaaccatcaaaggtatcgtcaagcggctccaggggctggaaaacgcagcggacgaactaagccaatggcaagagattcaaaccgcagccgaaagcattccccaggatgccaaggccggtgagctgctgaccgttctcaaacagggattttccctgatgaagaaaacgggagccaaacagaaagcggttatcttcaccgagagcgtggaaacccagaagatgctccagaatcttctttctgaccggtaccgcactctggcctacaacggcagcgccgattactccgtgatccgccagttcaaggaggatggcgaggtgctgatttccaccgataacggtgccaagggcttcaatctggaggaggctgctttcatcatccactacgacctgccgtacaacaccttaaagctggagcagcgtatcgaccgctgccaccggctgggtcaggaaaacgatgtgctgtcagtggccttcatcgacaagaacaactttgccgatgttcgcaagctggagctggtcaacaagcggatgttggtgacagacggtgtctttggtattaccgatgacgtgctgggcggttttacagatgatgtaaaagcagcctttccggtcattgcccagcggttgcggcccagggcacagattgagcaggcataccgccagaccctgagtacccacgaggaagataaccggcagaccgtctccgcagcggaggatattctgtttaccaccttcaccaaggaactggccgacaaggtgaagatcaatcccaagtatgtgaatcgccgtggacaggagctgaacaacgacctctgggaaattaccaaatggttttttactcgttataatgaaaagaacgatgattgccgttttgtgattgacgaattcaaccgtacgatcacggccacggagtaccgggaactgccggtgctgttctactactggacggggagccggaaccggccctatcgcagccagaagatgtacggcatggcaaaagacttcaaacccaaggccggacagattaccctgtccagtatcataggccgtgggattctccacgagctggagtgtgccaacgagggagtgctgaccatcccgacggtgcaggcgccgtgccagatagccctttatactgtcaccctggtttcaggctccagccgcacagaacacgccgtactgtgcggtttgacggatagcggcaaggccctggacgatgcagcttgccgcagcatctttgacttgccggtggagagcagcacggaggatgagcggagatccccccactggttaaaaggaaccagccgcccccacccgctggatcggctggtgccgagtgataagatgatggcggagcaactggagcgcctttcgcctgcccaggccgaggaaatggagcggatgaagcagcaagtgtccgctgataaggcggcattgagccgagaactgaacaccctggacagccaggtacagcaggcgcaagcggagctggaggccgtcaccggcgaccggctgaaacgtctggctgcacagaagaaaatcaaccagcttcggcaggaatatatgaagcaccaggagagccagttctttgacgccatgcggctggatatggagctggaagaaaaaatgaaaagataatcgaaacattaccggtgtttcaatagaccacgagtatgtagtgtgttatacaaagcaattcggacaccgggtattccgtggaaccgacagaaaaacagaacaatataagaatcctgacaatgacccccgtggcccttggacaagtgctaacatggtatcatactccggataggcataatgaagcctttccgccacctcaccggataccgccctgaacaattgatggcatagaaataatgcttcccatatgttttcataggaatccatccggtaggtggacaaaagtttctcccacaaatcctcggatatatacctttcaataaacttatagttcttgcctacacttaatttaaagcctgtttcgatgccgaccttccatgatatcattctcagcagctcatggcgaacaatctgattaaaatgatcaatagcaaataaaatttccttacggcacaatcctttaataacataaggtgttacattccaaaattcattgcagcaatcatcatactcccttgcgcttggctttcttacatgataatctatatcagtcggaactatgtcccttttaattctacaatctttatcaattagaacctttattaatttatcgccctttaggtaattatctaactcttccaagggcaataaggtatctttatcttcctctctaagatacttaactagccccggataattgcttatccttacagttcggatcaattagaattagccgaaaacggcggcgaagaaacgaaccaccgagaagcaccgccgcattgccgagcttgataccctcattgaacgactgtatgcggaccggaaaaggcgcggttgaccgccttgccctcaaaggcttaggggcatatcaactatatattggggccgagtgccgttactttaacaccgccgctagccatgagcttatgcttcctttaggacactgtcccaacagacactttttaaagtatgctgcactaatccttatttttcacagcatagcgcaatgacagacagccatgttctgcattctctgttccctgcaattccaaattaactttttcagataacagaaggttatcaaatagttagatgtctaaaaagcttgtagttaaagctttttagacatctaaatctaggtactaaaacaattcatccagtaaaatataatattttattttctcccaatcaggcttgatccccagtaagtcaaaaaatagctcgacatactgttcttccccgatatcctccctgatcgaccggacgcagaaggcaatgtcataccacttgtccgccctgccgcttctcccaagatcaataaagccacttactttgccatctttcacaaagatgttgctgtctcccaggtcgccgtgggaaaagacaagttcctcttcgggcttttccgtctttaaaaaatcatacagctcgcgcggatctttaaatggagtgtcttcttcccagttttcgcaatccacatcggccagatcgttattcagtaagtaatccaattcggctaagcggctgtctaagctattcgtatagggacaatccgatatgtcgatggagtgaaagagcctgatgcactccgcatacagctcgataatcttttcagggctttgttcatcttcatactcttccgagcaaaggacgccatcggcctcactcatgagcagattgctccagccatcatgccgttcaaagtgcaggacctttggaacaggcagctttccttccagccatagcatcatgtccttttcccgttccacatcataggtggtccctttataccggctgtccgtcatttttaaatataggttttcattttctcccaccagcttatataccttagcaggagacattccttccgtatcttttacgcagcggtatttttcgatcagttttttcaattccggtgatattctcattttagccatttattatttccttcctcttttctacagtatttaaagataccccaagaagctaattataacaagacgaactccaattcactgttccttgcattctaaaaccttaaataccagaaaacagctttttcaaagttgttttcaaagttggcgtataacatagtatcgacggagccgattttgaaaccacaattatgatagaatttacaagctataaggttattgtcctgggtttcaagcattagtccatgcaagtttttatgctttgcccattctatagatatattgataagcgcgctgcctatgccttgccccctgaaatccttacatacggcgatatcttctatataagcgtaccggttccaattttttcgcagtttaacttttccgacgcatttatcgtcttggtagtaaagatatattatcttatcagtattgtcaatatattcaaggcaatctgcctcctcatcctcttcatcctcttcgtcttggtaggacttgctactgccgatgctcgtccaaatttgcactatgatttaatcaatccggcagatggaagaaactacggatgccccgaaaaaggctggcgatatgatcgaaataccatgaatcggctcattcaagagggcaggattatttggcccgacaacccagatgggcggccgcgcaaaaaatcatttttgaacgagctgtcagacaatcttcctggtttttcatctgttttcagcactggcgtttatacaaatactgcaaccaaggaaattggaggattgtttaataagtatttatttgattttccaaagccagtcgaggttattaagcaattagtttcccaagtgtctaacacggatgacatcatccttgacttcttctccggttctgctactaccgcccatgcagtgatgcagctcaacgctgaggacggtggaaatcggcgctttattctggtacagcttcccgaactgtgcgacgaaaagagcgaggcatacaagaccgggtacaagaatatctgcgagatcggtaaggagcgaatccggcgggctggtaaaatgctaaaagatgcgcttgaaagttccggtttgtttgttcgtgcaatgaaacgccatcaagatcagcatgattcacttgaaggatttgcttatgcggagtgggaagaaagtccagaggtaatcaatgcaaaaaaagaaatggcagcaaaactggatgtgggcttccgtgttttcaagctggacacctccaatctggaaacctgggacgccacccccattgaggacgagcagctcgacctgctgtatcggcggatgaacagcatgattcatcgggtgaagccggagcgcaccgacctggatatgatttatgaaatcatgctcaaactgggtgtgccgctgacctactccgtgacaccgttctccatcaataacaagactgtctatggcgtgggcgatgactgcctgctgctggtctgtctggccgaggatgtgcagcccgaggacgtggagcagatgaccgaatatgccccggcaaaaatcatcatctcccgtgacagctttgctgacgataccgctatggctaatgcctactatatcctgcgggatcatgggattgagctgaaactggtgtgagaaagatatgaataacactctaaaatggtttcatgtaatcacaaaaaccattgtacattgcttacttggaacaatcgaatacattggtattccatttttacttgcttgtctttctacattcatttcccctatctccagcggtaatactttgtggctttggattgagcggattgctttttgctttacgatatacgaagtaattattgttggtgtgcgaaaaatgcagattgacatacgcaaagatgcactattagcactaaaaaccgcctacgaacgagcagccctgtattgtgaaacaggaaatcaagacatatatcggaacttaacttcaaaaatagatcaggtgcttgacaatgggatactaaatcaacttgatgttgtgcagagctataaaaatctcaagctctacatggacagcaaaaatattgttggaatcaaatatgagattatcaatattcagcactccattgaagcagataatctcttatggaactataccctgttcctgcggttatttaagaggtgaacaggcatgaaactgaaattcaagaatcaagccttccaaatggatgcagtcaacgctgtggtggatttgtttgccggccaggagaaaacacggagcaccttctccgtcatggaggaagcccagaccaatttcttaaatgagctgggccagggcaatgctctctacattgaccaggaaacattgaccgccaatatgcacaccgtccagaagcggaataacctgcccctgacccccacagcggaaggctgccagttctgtattgagatggaaactggcaccggcaagacctacgtctacaccaagaccatctttgagctgaaccgcaagtacggattcaccaagtttgttatcgtggtgccgtcggtggccatccgggagggcgtctacaaatcctttcaggtcacgcaggagcatttcggcctgcaatacgacaacgtgccatgccggtacttcatctacaactctgccaagctgtccgacgtgcggcaatttgccaccagttccaatatcgaagtgatgattattaacatcgacgctttcaagaaagcggagaacatcatcaatcaagcgcaggatcggctcaacggtgaaacggctatgggctttattcagaacacacaccctatcgttatcatcgatgaaccccagagcgtggacaacacccccaaggccaaggaagccattgccacgctcaatcccctgtgtgtgctgcggtactccgccacccaccgagaaaaaatcaatctgctttaccgcctgactccggtagacgcctaccagatggggctggtcaagcagatcgccgtatcctccaatcaggttgccggtggcttcaatcaagcctatgtgcggctgctttccgtcagcaacgacaagggctttaaggccagagtggaactggatgtgaagggcaagaccggagccgtgacccgcaaggccatgactgtcaagccgggcgacgatttattcctgctgtccggcgggcgggaactgtacgaaggctacaccgttaccggaattgactgcactcccgattttgaacatatcgagtttggcaatacccaggaggtcaagctgggcaaggccattggagacgtggacgagaacatcgtcaagaaggcgcaaatccggcgcaccatcgaaacccaccttgacaaagagctgcggtatctggacaaggggatcaaggtactgtccctgttcttcatcgataaggtggacaagtaccgccacgaggacggcacacccggcatctacgccactatgtttgaggagtgctatcaggagctgatcgcaaagcccaagtatgcgctcctccgagagcgattcaccacagatgtgagcaaggtacataacggctacttctctcaggacaagaaaggacgcctgaaggacaccaagggcgacacccaggccgacgatgacacctacaacaccatcatgcgggacaaggagtggcttctcagctttgagtgtccgctgcggtttattttctcccactcggcgctgcgggaaggctgggacaaccccaacgtgtttcaggtctgcaccctgatcgagcagaagtccacctttacctgccgccagaaggtgggccgtggcctgcgcctgtgcgtgaaccaggacggtgaacgcatcgaggacaagaatatcaatgtccttcacgtcatggccaacgagagcttttccgagtttgcttccaccctccagaaagagatcgaggacgaaactggcgtcaagtttggtgtactccagctcagtttgtttgctgggatgacctatcaggaagaagttacccgtgagcatacgattgacagagaagaggcccacgagctggtaaaaacctggatggacgacggctccattgacaaatggatggccgaccccgaaatgacggcagcggaagaaaaaattacagcggaattggaatcagggaaaatcaccgaaccgcccagccccgtaacggaagtcatgcgccaaattaaaaacggtgcgaccgctgaacaggcagcagaggcaattattggaatcaccagtacaatcactaccgtagaggaacataccgtcacccacgaggaagctacggagctgctggagcattttgagcagaaggggtatatcaccagcaccggtaaggtcaaggataccatgaagaacgctttgaagaacggaacccttgacctgccgaaaaaatatgaagctgccagagagcgttttgagcagattatcgccaatgccgaccggaagcccccggtgcgggatgcctcccgtgatgtggtggtacggctcaacaaacaggtcatgctctccccggagttcctggagctgtggagcaagatcaagcagaaaaccgcctaccgggtgagcattgacacagagcagctggtgaagaactgcgtcaaagcctttcaggaaatgccccatatccccaaaacccgtctggtgtcccagactgccgatattcacatccagcagtccgggatcagccacatggaacgggaaatgcggacgatggagattgccaacgattatcaggccctgccggacatcatcaccgccatcagcgatgaaacgctgttgaccccggctaccgtcaatcggattctggtagagagcggacggtgtggcgatttcctcaacaatccggaggcatttctggagcaagccgtagagctaatccgcagccaccgccacgccttggctatcgacggtatccgttatgtgaagctggatggccaggaatattatgtgcaggaaatcttcgacaccacggagttgcttgctaacctggatcgaaacgccgtaaaggtggaacacagcgtctatgactatgtggtttacgacagctccacggtagagaagccggtggcggtggccctggacaacgacccggatgtgaagatgttcttcaagattcccagccgcttcaaaattgaaacccccattggcacgtacaaccccgactgggctgtgtatctgaataagaacggtgaggaaaagctgtacttcgtcctggaaaccaagggtgacaccagctttatgcacctgaaaaccagtgagcagctaaaaatccactgcggcaaggagcatttcaaagcactggacgcaggtgtggagctggagactgcaaccagttggacggagctgcgcaagcgcatttgacagagatagaaagagctttttatctcacatctcgtccttgattcttgcgctttcccttgttggaaatctgctgctccttctgcgtctggcgcaccattctccgcacggccagccgctctgcatcctcgtccagcatccgggacaccgcctttttactgtcaaacatcagaagtgggctgtacttctcaacgtaaacctgctgtgcctggttctccgcttcctgttctttgccggggcggatggcctgtcttgcttcatacagctgcactgggtcgaagccctgggcctgctcccgaagcccggcatactcgttcagggcagcgtccaactcggcggaatatttctgttcctgttcttccagccgtttcaggctctgctccatggcggcgatgtctttgggaaatttatcggcggcatcttcctcggaatatgccagcgacgccagaagcagatttttctccgaacgcagttcctccaaatcctctgtcagtgccgcaatcttagccgccagttcccggtgccagaatacatgaaccgcagagagcgcctttttctcggaaagcagactgcggcgctccttcgtcttatcccgaatgtcctttgcaagctgattgtactgtgtgagggcagggcgcagcgtattcagcgaagcattcaggcgttccttgcccttgcggagataccccagctgatagcagaacagaagcaaattttttcgcagattctccatggtctcggcgagcgccgggatggtatttttaactgcctgcgccagctttttgacctgtcctctcagctcccggagcagggcattgtccgccttgatctgccggtttagttcgcaccggtcagagataatgccctttttctccatggctctggcaaccacaccctcatggaccgtgggccgctccagcagagcacgctcggcatggctgcggtggtcgatgcgttcttcgtgcccggtgcgctccagatggcggtttgccacatccgcccatgcagcccgccacaaaacaagctgctcgtcgctgttccagtgttccgtgatgggattttgcctgccatatttggtgcttttaggatatttggatacccgttcatagccctgcgcctgcgctgcggacggggccatatacaccttctttttgcccactttgtactggtactgtttctcccagccgtcggcctgtgcctgtttgaactcagcggcggtaaagccctgttcttcgccgtctttgacgcagagatattctttctcggtcttgtactgccattttcccttttcatccagcgggcgcactgtcagcaggatatgggcatggggattgtgtccggggggatacgggtcatggatagcagcatcagcgcacattccgtctgccacaaactgctccttgatgaaatcttgcaggagctgaatctgttcctcccggcttaactctatgggcagcgccgccacaaattcacgggcaaggcgactgtcctttgcggtttcggtttcctccacagcgttccacaggatttctcgatcctgccactctgcgggggcggtggctggcagaaaaacctgccgccacccaaggccctgtttgcgggtgtagtcgtgctgcaccccgtcatactcgttgagcatccgggaacagctcagataggccgcagcagctacggcggagcgtccagctccacggctgactattttggcctccaaatgataaatcgccattgtctatcgtcctttccgaagggctactgtgaaacgcagcagcccttcttccgtactcgattacaacaggtacgtcgtgaaatgcgacgtaccaccagcaggggtggagcgaatcgttccacccctgtatctgtgtcaagctgccggtggcaggttgacgcaggcaggcggcgggatggggtggcaatataccaccccatgaacaggggattccaaaacgaaaacccctgcgccgactgcatgggcaaggctggcagtttggcagaaatgcagccttgtccagcggctcccgcaggagtcgcaatccctctcggagagcgcacgtgcccgaccaacgggagggctaccaccgcctgctttagcaggtggtgagtaagtgcgcccttcgggatgaaaaagaggaaggcccccggtttcccggagacctcccagccattttcaatcgtgcgctgccagctttcgccgcaggtattcttccagattatcaagccctaccgcctgtacttccggcagcactttttccagcacagcgccctcctgaatgagccgccttgtccgggcttttcgtgccttcacccggtcccgtgcctgggcttcctccaagcggtgctttgcctgtaacagtttcttttcttcacttgtcataggtttacctccgtttctgccagatcaggtcatagcccagcacatcggccagctccacgacctctttatagcgaatagattctcgctggagcttggcggacaggttggaaacactgtccgaccagccgtattcctcatgaagccggtcaaccagctcctgcatggtgtatcccgcccggacgatctgtgccttaatttcgttgcgtaccgtcatcatcaaaaatcctcctaaatttacttgataaaaaagcgaagccggtacgccctctggcatagccgcttcgctgtgtcgtgaaaaattctcttatcaataaatccgttcagaattgccggtgtgatgtcccgtccataggtcgcaccttccgactttcccgttccgtgtgacttggtttgaaaccgtgcattttcccatggttccatgcactcggttcaccggggtgagaagcacggtttcgcaaaatgatttcttccaaccgtcaaatacttttcgattcccacttgccttgatttacccctccgattttgccagcgatttttgatatacaaccgctgaattgctataaaagggagaacaactgtcaatcaaagcgtacgtacgtacacgattcagcgccgccattcctccggcacatcttccggtacgtacgtacgcatcgaatcgccggaaaacactgatatatgatttctcaccaatacttcaacccccagaaaaccacgcacccgccgtccggctgcgttggtcacattgttgcagtattccagattgtagcggctctggcaggcgatcagagcttcgctgaagctgcgtggtttcagggcaggcaggttgttctcggtgcagtaaatctggtatgcttcgtacagttctttggagctggcagatagatcggctttcaggcgaacatacccgtcagaatccagaaaatcatagacattgttgttgtcccgtttgactgcctcccggttttctctggtgcggtcactttcggtgaacttgaagttgttggcggccagccgctgcaatccctcaaaagcccacagcagaataccctccacctcggctttcatcttctcggccaggtcgggatcatccacacggccagccggtttttcttttgtggtcagcaccagctgacggcggtaaaatccgtcgctccggtcaaacagcgcctgcaaatctccgttggagaaagccagcagccgggcgcacatccatccctgatagctctgcttgcccttgcgctccaaatccattttgccctgggcggtgacgatggattttacatagttggtctggcgcagagcctccatccgcatatcgtcatccacgcacaggaggatatgctccagatcagcacgggcaaaccggttctcggatattttcccgatgctgccgtccttcatgttggaaccgaacaaagttcccagcacagcgccgatctgcgactttccttcgccgccgctgcccttaatcaccatcatccgctgtcccttattgctggggatcaggcagtagccgatatattcctgcaaggtgggaatatcctccgggtagagcagaccatccagaaattgcagccagagaacaggctttggggcgttggggttgtaggccacggggaaacggttgcggacgttttccggctttccctccgcaaaggttccatccagaaaaagcgtcccgttggaaaggtgaatccggtccggctccgggggaaaatcctccaccagcgccgccagcttcatcagctccacaatgttgctgattttgcggggaatgttgctgaccgcacagcatttcagctcctcaaaaatctctccccgcaggggcagttcgtctgtcacacggccttcgggcgtgaaaaaagccccgtttgtgaagatgatcttgtgcgtctgcaagaactcctcacaaaacagggcttcgttgatgctttttccatcaaaccagacgggcatcccgtcaagctgcgctttgtttttcatgggcatcgtcctcctttttcagcctgtccagccgttcctccaaaccggcgatcagaccatccttgttcagcatttctacgatttttacccgttgttccagctcggcggcaatgagcaaatctgccagatactccacatagtccagcatctggcaggcttccacaaaccggtcatccagaacatcttccggtgtcttgggtgtgtgctgcaccttccagcgttccagaagatgcagataatcgcacaatacccgcaggcagcgcacttgctcctgccggtatgctttcagcaggggacgctccggtttgggcagggcagctgccgcaggcggcttgtccgggccaatcccaaaatcctgggccagcttctgtgctgcctcgtagctgctcaggtcaaacagcttcgccacaaggtcgatcacatcgccggtggctccgcagccgaaacagtaaaaataacgctcgttcagcttcatgctggggtgccggtcctcatggaacggacagctgcacatcccgtttcggctgacttgcagcccatagtgttcagccgcatcgggcacacaaatattctgttttaccagttcaaagagtgtcataaaaaatccctccgtttcagggcataaaaaatgcggcctgcccggtttatttgggcaggccgcaatccttatgcagtttgtgatgcttccgtttctttggctttccgcttttcctgccggtagaacttctcccggcaggcgggtttgcagaatttagcgttggggcggatagactggaacgactctccgcagcactggcacaccagctggtacggttcacccggaacgatcagcccttcggcaatcttctgtttgcgctccttctggcgcagatatttttcatggtcacggatgcgcttctggcggcgcttttcctccgcagccagttcttcctcggtgggttcgggcatgggcacttcaaatttcccgataaagttcaggtaaatctcgatttcctgaacccgttccccggtgcttctgtccggggcatggaccagaatcttctccacaaattcatggatcataggggcggtcagctcggtgaaatctgtatatttctgtgccagcgccagaaagtgactggcacggtccgtgtcctcatggaactggttcagctgcgcctgctcggaggcaagcagctgttccagctcggcctgttccttctcatattcggcacacagcagctcgaaccgtttttcctccaacttgcccatggcataggtttcatacagctttttaatcagcacgtccagctcggcgctgcgcctgcgctccttggcgaccttgcgtttcagctccttggctgcttcctgctggcgaacctgtgaaatgctgcgaaccttctgaataaattcctccctgttctggatggcatagctggcggtagtgcggatggtttccagaatcagggcgttcagagccttggtgctgacgctgtgggaaaaacacatctgggtttctcgttcgatggtcaagcagtaggtggaacagttataggtgtcgtttctgtactccttgccatctgcccgtgtgtgtttgccccggtggttatacatctttgctccgcagtcggcacagaacacaaggccggtcaggggattggcgacgccagtggtatctgtccggcgcaccgtccgcttcacctgctgggccagctgccaggtttccgggtcaacaatggcctcgtgggtattctcaaaaatcagccagtcggacgggtcattttttacccgcttatcccggtaggactttttggaggaacggaaattcacggtatgccccatatattccggtttctccaacatggagctgaccgtaaagccgtaccagtcataggggcggctggtgtccacggtattcttccggctgcccctgccgttgcgggccagataataggcggggcactccaccttctcggctgtgagcattttggaaatctcataggggccgtgtccctccaccgcaagccggaaaattcgccgcaccacagtggcagcttcctcgtccaccagccagtggtccttgtcctccgggtcttttttgtagccatagatggcgttgttggtggtgggcttgcccgccttgcccttgacacggtatgctgccgaaacctttttggactggtcacgcagataccattcgttcatgatattgagaaagggggcaaactcgccgctgtcctgttcctcgctgtcaatgttattggcaacagcaacaaaatgaaccccattctgccggaacattacctcggtgtaaaagccggtttgcagatagtttctgccgatccgacttaggtccttacacagcaggtgggccacctttcccgcctcgatgtccgccacaaggcgcttccatgcgggacggtcaaagttgccgccggaccacccatcgtctgtgtagtggacgatattggtgtagccccgctgtgctgcatagctttcaagataacgtttctggttcagaatggagttcgagtcgcccgtgaggtcatcgtcacgggacaggcgctcatagagcgcagtgattttttcttccgtctgtctgtttgccatatcaggcgctcctttcagacggacggctcatttgtggcagttccattataccacattccggctggtttgccagcccgtcattgcggatcagccgcagaattttatcttccatcgtttcctcggcggtttcgctgaggtagacacgaactttataggtggtgttgccaatgtgccgggtcagaaacacggcgtttttatctgccatagaacctctctttcttgcgctttcggcgcatccggtgtatactgttgttatggttccgttatttgtaacctgcgattatgttacttttttgtgtcaagcctgaacatggcgaaagccccctttctcctgtgtgaatgagcgaatgtaacccaagtaacttgtttttagattactctttcactaataggagaaatccggggtgcaaaacggaaccatttttgaaaaatcgcaaaatatttttttgaaaagaggtggggtcatggcgtatctgtctgatgacgagcttctggataccgagggtggcttcaccggatgggacgatgagacaggcgctggtgcaacggaggaaacgctggaacaggcgcttgcggaagaacgtctggccgagctggaaagtgagctggagcaggacgagcatcccatcgactatgaagcggagctggaggacgaggaagaagaagccgccccggtcaacgaaaagcggctgaaacgggagattcgagcggaagctgtgcggcggctggaggaagcagcacgcacggagaaggatttccgggccgtggtggaggaatggaacaagctggaccggaaccgggagcgccgggaacgggaccacgaaaaccttcgtggggatgtgccgctggaatatcaggcggtgccggaacccaagctcattccccgctggatgaacaatcccgcataccggcagctgatggccgggaactttctggacatcctgtttgactgcccctatgagatgcacaacctgaccgctgacgcctttatatcccgcatggtggaggaattaagcgaggaacataaggaagtcctgtatttcctctctttgcggctgtacagcaccacccggcttgccgctgttcgtgggcagtctgaccgcaacattcgcaaactgcggaaaaccatccacaagaaattgcagcgccagatgtatgaccatctgtgcggcaagcaggagcatggcggcagcctgaccttgcgggaacgccaatttttggaggaatactcgaaaatcgcaagaaaacagggcaaggacgccgtgatccggcgggaaaacaagaccaagcgcagaaaaaagaaaaaccgcccctgataattgggacgattaaggagaaagggcgtgtatgatgaaaaatttgtttgaacagtcccgttcccattgggtgcggtacgatcactacgagctgaaaacagcggaagatggcaagcggtacatcacccccggcaagagtgcaaagccggatgtctacaatccgctgaaagaggtccccaacattgtgctggatgccctgaatgtagggatgttgatgatgggacgcaagccggaagcagaagtggaaaaggcagtgatggagtttgtcacccggtacggcctgctggggctgatgaccgccctgcccaccacgccgtcttttatggactatgaggcggtgtacctaccgaaaaaccactttattaaggaagaatccatggcgacggacaaatatctgtccctgttttatccctttgatcagctggatttggtgaagaaaggcattgaatccacatggaatgtgtccggtgaccggacgatggttgccctgaccatgaccttcatggacgagccgatggcgaagaacatgagcttccagcgggaatatgcggaaccctacgactgggttgcccagcagttcaaagattgggcctttacactgaccaccgccattttgtactacaatgactatgattccattgacgaggacgcacgggggctgtatcgcaaggccatggctgcgttcggcgggattgcccccagctaccacattgagctgttggataagcccaccatctattgggatttccattcgctgctgctgggcatccagatgatgttcagcttcatgctggtagacggtgaccagcccctgcgcctgtgcaagcactgccagaaggtgttcctgggcagccggtccaatgccgccttttgcagcccacggtgcaagaaccagtataatgtctacaagagccggggaaagaaccggacggatggaggtgacgaggaatgagcgaggaacagggactgaccccgtatgaaaccagagaaatcctcttttacaagaccgaaaacggagaagtgcgggtggaaatcctgctctttcaggaaaacctctggctgacacaggcaaaaatggcagaactgttcgaggtgcagaaagcggctatttccaagcatctgaaaaacatttttgaatctggagaactgaacgaggattcagttgtttccaaaatggaaacaactgcggcggacgggaaacggtatcagaccaactattacaatttggacgccattatcgctgtggggtatcgtgtgaactccaaaaaggcgaccatgttccgcatttgggcgaaccgggtgttgaaagagttcatcatcaaaggttatgtgatggatgacgcacggctgcgggagccggagaactttttcggcaaggattattttgaggaacagctggagcgtatccgggacatccgggccagcgagagaagattttaccagaaaatcacggacatctattctcagtgcagcgccgactacgatgtggaaagccccatcacaaaggagttttttgccacggtgcagaacaagctccactatgcggtcacccatcataccgccgccgagatcgtatacgaccgtgccgacagcaccaagcccaacatggggctgaccacatggaaaaacgcccccaaaggccgcatccgtaaatcggatgtcaccgtcgccaaaaactatctgaacgaaacggaaatgcgaaacctgaacgagatcgtcaccatgtatctggactatgcggaacggcaggcccgccggggaaatgtcatgtatatggccgattgggtcaagcggcttgacgcatttttacagttcaacgaggaagatattctgcatgataagggcaaggtgaccgccgctattgccaaagcctttgccgagaaagagtttgaaaagttccgggtattgcaggacagaagctatcagagcgactttgacaggctggttgcggaaacttcggatgatctgacagaataaccatatacacagaaaacccacgcttccggttctctttccggctgcgtgggctttttcggccatcgcttatttcttgttttgcagctgttcataggcttcctgatggacgatcagccctgccgaaaagccatacttgaaatggctctcactttcctcgcattgggcgatagcgttctgcgcccggagttcctccaccagcgcatagtcctctttgctgagccgctgggataactgctccatcaacgctgcacaggtttggatcgccttgtggtattccggggacgtgggtacgactgtttcacagggataaaactctccattatacatggcttctaaaatcatggtgttccctccctcaacagtagaccagctcagccaggacaatttcctcggctctgttgtggatggagttcatggagcgcacccatgccatctggtcggcagctttcagggcttctgtgacgccctcttgctgcatcatggatttttcaatgatttccagccgctcccggcaggcgatgtcgatttcctccaagtggggaagcagcttttcagtgacaatgagatcggtatacagaatgggccgatgttcttttaagtaggcacggcgcatccggccatatttcccgatatggtactctttggtgtctgctaacacaaggttgggaatgagatagtcgccgcattgggtgtaagtcagttccatacaaggctcctttcgtgagaatgtggttgacagttacggtaggtttgagggcatccctcctttatcataactgtcttttcattcgccacaaatgagccgccagtcatgatgtaatgttttttggtgtaatccaccctctatacattacatcatgattggaaatggaattgctctcacgctgttggtcatcatctttgccgaagtcatcacggctcagtcgttcgtacagagctgtgattttctcgttttttctcataacttgtgctcctttcttcggttttaggttgtgtgttctaagagacttcccaaccgcttgattaagaagtcttttagagcatacaacaccggctgccagcttatatttcttatactgccgcactgcgaagtggtttggcttttccgattccagtgcatcaaacatcaggtctacaggatttttgaactcctcgtcatcctcccggacttccatggcgttgatgaactcgatgagggtggagaagttttgctcctccaccggagcttcatagtggatatatccgatcaatgcgcaatacagcaatgtttccgccttgacccagaaatcgtctccagccttgccttcgcctttggtattggcgatcagcgttgttaccagcttcaagatgtccttttcgctatggatataggcgaaagggttatagtgcatggacttcttgaagttgattgtatttaggaccttgattcggtacggctcataaatgaccttgccgtgcttatccttcatgggctttccgtctttccccggcttgggtgcgcccctttggagcatttttccgcactccaccaaaatggttcccttcgggtcagtcacgacgtagctgctgtgcatctgcatcagattcggtttgagccagaagcgggtcttaccggaaccggagccgccaatcaccagtacatttttgtttctggcagtctttgggtccttggggcggctgttcatggtcaggctctccgttttcgtcagaatcacattgttctgaaatacaggatcaacgtaaggtgcaatatcctcacgggttccccagcgggccgaaccatattccaatccatgtctatatttcttagcgttcttgcttttaagataaaccgccagcctcagacagcctccacaacacagccctaccaacaagtccaatggatgcaggcttggccagaaactttgcagcgccccaggcagaaccgcaaccagcgaaagaaacttttctgaagcatccgccccttgtgccattcgccatgcctctccaaaattggtagcaaacagccccagcaggatatacggcatattcagcaaaacgagctttttgatgtccaatgtctttttcatcgttccagctcctttcgcttggtgcgatccaccacagcatttttgaccatctctttgaactgactgagttttgccagcacagacgggcgttccgttttctcggccttcttgacttttttattggtgtactctgtaaaggctgctgtcagcgcatccgcatcgcgacccttgaagaaaatcaggtactttggcggagaactgctgcggtcctttttcaccgcataatccacaccatatttccgggcgattttctcaaactccttgatagaggggtctgtgatctcaatgttggatattccctgattctgcccgacaagctgcttcacagtctgttttccatgcggaacaaccggcgcatcacggcttctctgtttttccagcttcttttcctttcgatgtgccatgtacttgcttatggcagccttaaacattctgccggtaaactttgttccactgacaaccagcgtcaaagttctgttttccacttcttcctgcattttctcgcctcctttccacgaagtttgcagggaatctctttttttgctaaggcggaaccaccagccgccgcagaagataacgcttcataccgccctccttagcgtaactggtcagaatggtcatagtgcagattgccctggcgtacctttgcgtggctcaaaatcttaatctgccccttttcctgactatccagtgctttttcataaccggtatccgacaggaacaggcgggttcgttcgcctttccagccaacaggggaatcgtttgtcagcacatcaaaaataatcatgtgccgggtgtcctccgcaaaacgctggaggtccatatatccatgaccgtgataattctgcgctcctgcctttgcccgcatttcttccatcagctgccctatggtctttccctcagacatcatgcttgctcctttctcccggcagttccgggcaataaaaaagcgaccatttaccagccgccatacagatcgtgatttacttgtgaggtgtaatgattgcttatcgtggtcggtgcattgaacagaacggtcagaagatactgcttcatgttgcgaatttccgtggtgttcttctgtaaacagtccatgacaaactcaatgtgcgagttatccagcttcaagaacctggaacgaacgatttcatgcggaaaatcgcttcctgcaatacgggtggtctttcgctttgcacagaccgtttccacgattagctccacaatctcatccaaatcctcccgataagtttcatactgctgacacaggtattcatacccgatattctcctgaatcaattcccgataactctctatctctgtgagtgacatcgcatcccttcctttccgttccggcagacaatctgccgcgcaatcccggaagggaatggaatcggtacttgatccataaatattttgtttttgagtatttgatttctctatatttaattctgcgggcttttccgtatccggtttatccatatacgggttttccgtatctggtgaatccgtatccggttttctaagctgtggctgctcgtatatgacatactctatatcgctgatgcgtccctgccggtcacgcagcttgtgccgcacaatgtaaccggcagcctccaattcccgcaacgcagcgcctatggcatccacgccctccttacagatctttgcaagaccacgggtggtgtaattccagtcctctggcaaagataacatcatggaaagcagtcccttggcttttaacgacaggtttgcatttcgtaaatgatgattgctcatcacggtataatcacgggtccgttcaatgcgaaaaacggccatcgacctcactccttccgaattttgggtacaaaaaaaccgcaatcctcattccaaagaattgcggtgttcaacacttttcaaattttcttgcatagaaccaaaacagcggctttcgaggacgcgcctctgtaaatggctcctcctgggcaaaaggaagtgtttgcatcactcggtcaatatcagttgattccatgtcatgctgagatttgcaatcttcccggattgcttcttgaatttcctttaccgtacacatagtcattcctttcctttcgttgtatgagtttatgagcggcggcgttttcccggtttgaaatcgaggatatgtccctcaatcacacgagcgtaacgcttgatcttgatctcccggcactgctggctttgcagggcagcctgatacccgtcctcggtcaaaaacagccgcatttcctctccggggctgccgtaagctgtgctgggacgcaggacggaaaactcaatcatccagcgggtgttatcccaaaatctctctacggcgagaatcttgtgtcctttcagctcacgggctgaaatatccctcataggcggctcctttcatcgttcctggtctctctgacgctttttctgccatgcctccagcagcttgatgatggtttcctgcatccgctggggcgtatagcttttagggaaatacttccgcaaggtgtcagaggtaaatgtcactcggtccagatcgcttttcttttcctcacccatgatgacacgcatcatatcgagggtcagatgcccctcctgactgtattttttgagccgctgggcttgagaaagagaaggggtagcctgttcgctgtccatcgcgtccaacaggtctacctgttcctcctttttgagaaaggacagctcataagcaggatttaaggcaattttcttttcatccaccatgtccatcaattcaggaatcagctctgtcagacggatatagcgctgaatttgatttcgactttgccccacctgttcagcaagcaactggtctgatcgcttttgtgtcccaacttgggacacattttctttactcggtctgccagcctgtcttttcatggcatccagcttcatcttgtaggcaaatgctctttcactggggagcagactttctcgttgcaggttgctgtcaaccataatgatcgtggcggcatcatcatccaaatcccgaacaatgaccggcatggtctccttttctgccagctcactggctctgtgccgcctgtgtccggctaccagctcataaccgccctccgggtctggtcgagcaatcgccggaaccagaacgccatactgcttgatactgtctgcggtttccatcatggcttcgtcatccttgactttgaatgggtggttcttaaagggatgcagttcagacagcggaatctcctgaatcttttccagctttgcatcctgacggccttcttcggtggagaacaaatcatctaccgaggccagctctatttttttcgcgctgcttttcaagtttcaacacctccttcgtcagatttcgatacccctctgccaccttgccgccagggtcatgggcgaaaatactttttccctctgcgctgatttcctttgcccggacagaatgggggatttccgttccaaagactttgattttacttccataggtgtcccgcagcaaagcagcaatctctttggcaaagttggtgcggttatccaccatcgtcagcaggataccgtcaatctggagctttggattgatctgccgtttcaccttactgaccgtagatagaagctgttccagccctttggcgggcagatactctgcctgaacgggaattatgatcctgttcgcagccgccagcgcattgaccgtaagcattcccaacgagggctgacagtcaatcaggatatgggaatattgtcccttcagtgtgtccagatattgccgtaaaatcgtttcacggctcatggcgtttaccaaagaaacctccataccggaaagctgaatatccgcaggcatcaggtcaacgccttctgcatgatgcagaataccttctccggggcgtataggctgatccatcagaattttgcccattgcatccgacagtgtaaatggcagcttgtctggttgcggatttcccaagctgattgtcaggcttccttgtgggtccccgtcgatcagaagcactttctttccggcctgtgccagacctattcccaagttcgcacaggttgttgttttgccaacgccgcctttctggttggcgatggcgatgatttgtgtgttcatgacttcacctcatttctgattgttgctgttgtttctggaaatagaaaaagccgccacttcaaaattaacagtgaagtgacggctctttctatcgccggaatacgagttcctgaaatgaaaaaagcacccagcatttatactgtgtgctacatcaaattcatattcaattattcaaattagctcaaactatgccaaactgccacagccaaaaaacgaggggaaggagggctgaaaagcaccccaaaaatcggctctcggttaaccactttgggaaccacttccccctctttttgccctctttttggccagttaaccacttgcggaccactaaaaattggatgaaatcggctctcgttttgccaaatttggtcaaaccatatcagcccgtttagatatagcaaaagcccggaaaaccttgattttccgggctttttgaaccattttgatatagtctgagcagtcgattatcgcttgctgaactgcggagcacgacgagctgccttgagaccgtatttcttacgctctttcatacgcggatctcttgttaagaatccagcggactttaagatcggtctgtaatcagcatctacgttcagtaatgcacgggcgataccatgacggatagctcctgcctgacctgtgtaaccaccaccgcgaacgtttactaatacgtcaaacttatcagctgtctctgtagctgcaagcggctgacgaacgataaccttcagtgtatctaatccgaagtattcgtccatatctcttttattgattgtaaccttacctgtacccggtactaagtatactctggcaacagatgattttcttcttcctgttccgtaatattttgcgttagccaatgtcttttacctcctcattaaaatgttaaagcttctggcttctgagctgcgtgcttgtgatccggacctgcgtatacgaataactttgtatacatctctcttccaagaggtcccttcggaagcattcccttaacagcatgctcgatcactctctccgggtgcttagccatcatctcttttaatgtggtctctttcataccgccaacataatcagagtgattgtagtaaaccttctgatctaacttcttaccggtaacctttaccttctcagcgttcactacgattacgtaatcacctgtatcgatatgtggtgtaaagattggtttattctttcctcttaataccttggcaacttcagatgccaggcgtcctaatgtcataccttcagcgtcaactacataccattttctatcaatggtagctgggctagccataaaagtcttcatcgttattcctcctagaaaaatgctgttcatctcaggcagcgtgaatgtccggcacactgtcctccatgtcatattgtttatagttaaatggcactccggggctttggaatgacatttattcactatcacagacttacatattatattacacgactccttgcgtgtcaatatctttttcttccatatattcaattcccatcatggtcagtccgtgcgccggtgcggtcggtcccgcagcctccctgtcgcgcgccgcgaggatctgctctatctgctccggctcgatctgacctccgccgacctgtatcagcgtcccggcaataatgcggaccatattgtacaaaaacccgttgccggtcacccggattgtgatgatgtcgtccgcttttgtgacgctgcacgcatagattgtccggaccgtggtcttcacctgcgcgttgaccgcacagaagctcttgaagtcgtgctctccttccaggtacaccgccgcccggctcatcttctccacatccaggctgtggtggtaaaagtaagtatccagccgtctcgtcggcatgcggaatgtccggttcaaaatgcggtactcatatgtcttgcggctgttctgatagcgcggatgccagtccgcaggaacctcgcaggaatcctgcacgacaatatcctcgggcagacgctgattcagcgcaaacgaaatcttatccgccggcatgcgcgtcgtcgtatcgaaaattgccacgtttcccagcgaatgtacgccggaatccgtgcggctcgcgccggtcactgtgatctcctcccccaaaagcgaggaaagatggcggttcagcacctcctcgatcgtgattccgttgggctgcacctgccatcctttataattcgtgccgtcgtacgccacgatcatttttacacgttttacctctttctccaaaccatttctccttgcagctttattgtggccacggcacaaagattctgcacagaataatgagcgccagatacagccacatgatcagataggacaggcggtcgcgtccctcatagcgcagcggcttcatcttcgttctgccctctccgccgttatagcagcgcgcctccatcgccattgcaagatcatccgcgcgccggaatgctgacacgaacagcggcaccagaagcgggatcatgcttttgactttttttaacagattgccactctcaaaatcggctccgcgtgccatctgcgctttcatgatcttatccgtctcctcaatcagaatcggaataaagcggagcgcaatcgacatcatcattgcaatcgcgtgcaccggaacaccgatcttagaaagcggcatcagcgctttttccagaccatctgtcagctggttcggcgttgtggtcagcgtcatgattgaggttccgagaatcagataggtcaggcggatcgccatcagcaccgcgctggtcacgccttccttcgtgatcgtaaaacgccagacgcttaccagtgcctcaccgggcgtcaaaaacagattgaacaccgccgtgattaacatcagaatcatgattgcctttaatccctttaccatgaacttaaacggcaccttcgacagctttatgactgtaatcagaaataccgttgcaatcgcaagcgctgccacgccacggaagcagaacagggatatgatatagatcattgtactaaacagtttcacacgcgggtccagtttatggatcacagaatctgccggataatactggcccagtgtaatatctctcaacatgtataaacttcctccctaccggaattcttcatcggcgcccgccggtgactctttcctccgtaaaatgattcctgccgcggcacaccttaccggtgaatatcgctcctgccggaatcaattcccgtcaatgcctgcatcaggctggctctggcttcctccaccgtcgtcgcctccgtatccacggaaagcccgtgctccttcagttcgtgcatcaggtaagtcacctgtggagccgcgagtccgatcgtctccagctccttatagtgccggaacacttccttcggtgtgtcgtcgaacatcacctgtccatggttcatcacgataatgcgctccacatacttggcgacatcctccatactgtgcgacaccagaatgaccgtcatgtttcgctcgcggtgcatccgtgccacaaggtctaagatctcgtctcttcctgccgggtcaagtcccgcggtcggctcatccaggatcagcacctccggcttcatggcaagcactccggcgatcgccacacggcgcttctgccctcccgagagatcaaacggcgactggtaataaagctcctccggcataccaacactgcgcagtgcctcaaacgcccgcagtcccgcctcttccttggaaagtccctggttcttcggaccaaagcagacgtcatcaaaaattgtcgtctcgaaaagctgatgctccggatactggaacaccagtcccacccggttgcgcagttctctcaggtcaaaatcttcctcataaatatcctgtccatgaaaatagatcgttcccgaggttgccttcatcagaccgttcaggtgctggatcagcgttgacttgccggaaccggtatgtccgatgatgccgatgaactgtccgtccttaatctcaaggttcacatcctttaacgcctgaatctggtacgcggtctcctcactatatacaaaattcactttatctaaaataattgacatttctactctccgatctgtgccacacgaagaatcgcgtccacaagttcctggcggtgcagcacaccgacgggtacatcaatgccggactggcgcagcagatctgctaaaatcgtcacctgcggcacatccagtctgtactccttgagttttcccacctgggagaacacttcccgcggtgttccctgcatgacgacttttccctgatccatcacgatcaccttgtcggcgtccacgacttcctccatataatgtgtgatcaaaatgatcgtcacgccttttttccggttcagttcatgcgccgtgcggatgacttccttccgcccgttcggatcaagcatggcagtcggctcgtcgagcacaatgcacttcggttccatcgccatgaccccggcgatcgccacgcgctgcttctgtccgccggaaagcttgttcggcgaatgatgacggtacgagagcatccctaccgcaccaaggctttcttccacgcgcttccagatctcatccgtcggcacgccgatattttccggtccgaagccgacatcctcctccacgacgctcgcaatgatctggttgtccggattctgaaataccatacccgcagtctgacgcaccgcaaatgtattctcttcctttgtgacatccctgccatccacccagagcgagccttcgctcggcagaaggagcgcgttaatgtgttttgcaagcgtggatttgccggaaccattgtgtcctaaaatggcaataaaatctcccgcttccacatccagatcgacgtggtcgagcgctgtggagatggactccacattgccctcctcatcgcgtctgatatattcatgaaccaactgtcttgccttgataattcccatctgtaccctctctaatcttcccagcgcagccggtgcagctcgccctgcagcttcatgtggtcaaactcattctgccgcaatgcctcatacagcacaatcgcaaccgaattggataaattgagtgaccgcgtctcgccgatcatcggaatccgcacacaggtgtccggattggcttttaagatctcctccggaatcccggcactctcttttccaaacataatgtagcagtccggctcataggatacctcagtgtatacatgtctgcccttcgtcgtcgccatataaattttagcgcccgggttcttctcgcagaaatcttcccagttgacataggtggtcacatccagttcactccagtaatccatgcccgcacgcttgattgctttctcatccagatggaatcccagcggttcgatcaggtgcagtcttgtccctgtcgccacgcacgttctgccgatatttccggtgtttgccggaatctccggctcatataatacaacattcagctttgccatgtcagtctccattcgggaggaaacgccctcctccctttttcttatgatctcttgcgaagatctgtgataaacgcctccatgcggttcatcgccttcttcaggttatccagcgagtaagcataggaaatgcgcacaaatccctctccgcagtctccgaacgcagtgcccgggacaacggctaatttctgctgattgagcagctccgtcgcaaattcttcggacgtcattccgaactccttgatgcacgggaacacgtaaaatgcgccaaacggctcaaaacaggacaatcccatctctttaaaccggtgcagcagatagcggcgtctgccgttatactcctcgcgcatggcagccacatcctcatctccgttgcgcagtgcctccacgcccgcatactggctggtggacggcgcacacataatcgcgaactgatgaatctttaacatctgctcgatgatgatgcgcggtccgcacgcataccccagacgccagcctgtcatggcatgggatttggagaaaccgttgatcacgatcgtccggtcacgcattccctgcagggaggcaatcgtcacatgccgctccagatacgtcagctccgagtagatctcgtcgctaatgacataaaggtcgtgctctcttacgatgtccgcgatcttttccagatcttttttctccataatggcgccggtcggattattcgggaacggcatcaccagaagcttggtcttcggtgtgatggcagcctccagcgcttccggtgtcagacggaattcattctccgccttcagctcaatgatcaccggaacgcctcctgcaagcacggcgcacggcacgtaggacacgtagctcggctgcgggattaaaacctcatctcccggatcaagcatggcgcgcatcgccgcatcgatcgcctcgctgcctccgatcgtcaccatgatctcatgatccggatcataggacaccccgtaatgccggtccagataatggtcgatctccacttttaattccttgagtccggcattggatgtatagtgtgtctttcctttttccagggaataaataccctcgtcgcggatatgccacggggtatcaaaatccggctcgccgacacccagagagatcgcgtccttcatctcatggacgacgtcaaagaactttcggataccagacggctggatcgttgtgattgtcttatttaacggatctctcatcttacatctctatcctttcatctttgggctgctctgccattacggttccatgatccttatacttcttcaggatgaagttggtcttcgtgctgagcacggaatccagcggggaaagcttatcagacacgaactgcgaaacctcgcgcagggtctttccctcgatcgtcaccataaaatcaaagcctccggagatgaggtaaacggaattgacctccggatagttgtagatccgctctgccaccttgtcaaagcccatgccgcgctgcggtgtcacacggacctcgattaacgcggtcaccttctcaatgcccgctttatcccagtcgatcagtgtgtggtagccgcagataatgtgctcctcttccattttctcaagctcattcataaccgttgtctcatcgacaccgagcacaatggcaagctcctttaagtcaatccggctgttcttctctataaatgtcaaaatcttttcacgcatcgcttcttctcctttatatcgccttatataattcgtccgccttcggaggctccaaaaatctgcgctcctcctcgttcaaaaggacgcggtcgttccccgcggttgcctttccgataatcgttgcagggattcctgccttctccagttctcttaccagcagattgccatcctctgccgccatcagcatacagccgctggaaatcagctggtaggggttgattccgaaaaattcacagacctcaatggtctcctgacggaccggtatctttttcaaatcgatttcaagtccgacgccagatgcttccgccatttcccagagcgcaccgaatattccgccctctgtgacgtcatgcattgcactaacgccagacttgacggcgactgcggcctctgattgtaccgatatataagcatccagtgcttttgccttctcgacaaaaggcaccgagaactttgtctttagttctgtctctttttcctttgcgataatggaagttccctcaattccgatccactttgtgacaagaatatccatacccggtctcgcccctccggtcgagatcagacagccatccttcactttgccgacaccgcagacggagatcaccggctgattgaccaccgccgtcacttccgtgtgtccccccatcacctggatctttgccttggcgcaggcttcctccacttgtgccatcatggcacgcagttcgggctcctccacgctctccggcagcagcaccgtgagcagcacgcccaccggctccgcccccgcgcttgccagatcattcactgtaatctgaatcgcaagtgtcccgatgtccttcgccgttccggtaatcggatctgtggacatcacaagcgtctcatcctctgccagcttgatcgcggcgcagtcctctccgacgccggctcctaagacaacctcggggcgtctggtatgtatttgtttgaatacggagcgcttcagtacgctctccggcagttttccgatcttcatctgtgttctcccgtttatttacagcttaaggctgtctcttctgaggcagccttaaacaatctcttatacttttattctccgcctgtgatctggctctcatccaccgttccggtaatcgcctgctcttcctgcgacggctgttctaccggtgccggatttaagattgctgccgcactcgccgcataaggtgcaaccgccgcattgatggttgcctcatccccggtcgcaagcgccgcgccaatcaccgcagacacattcgggtctgctgatgccgttcccacgtttacaatcttcggagacgccttgtaggtactcttattaaaaatctcccggctctcctccacaccgtctaccgtgacaactttccaaagtcttgccacatagccgatatgcttgccctgcgcagtcttcatataacccgccggatctccggtcgccacatactgtgtgcccggatcctgctcggataccacttcactctcataggtcacaacccggttcgacggtctcgtgtcatgtccgtagatcttaaaggtgacattctttccctcagtgtatccctcaatataaatcggaatgtcctgattattgacaaaacgcagatccttgtaatcgcctgcaatcgctgcgtccatggatggcttcacatagcttacgatcatggaatgattcgagcgctgcgtgatctcaagctctgccagaatgaccgcattgtacaatgtcgtagatacctggcacacaccgccgccgtaggactcgaccgtctgaccgttctcataagctcctgccagttcgtatccgtttgccgcatccagcggtccgatcgcttcatagacggaaaattcctcgcccggataaagcagtgtaccattgatcttgctggttgcattggagatgttgtcgcagcggttctgaccggaatccttgtaattcgtcgtatagcttcccatcatatccgtgatctgctccagatcttcctcgctgccgcgcggctccaccacttccgccacgagctcgatctcggcgttgccaccgtcccactcactgctgatatagttctcgatcgccgcaatggaatcctccacgttgacctcgatgccctgctcgcccttaatgatcttaaacgcaccgttctcacgaaccagaccattatccacagcctcctggttcagctgcgccgctttctcggaaaggatggatgccaccgcatcggaatccacatccagtgagagtgcaatcactttgtccccctgctgcagatccttcttgtccttgtaccgcttgatgaggttgccgcttctgccgacatctatcgcctcgtccaccacgtttaaattggaaaaagatattcccagatcagccgccgtcacggaaacgctcttatcgccggtcttcaatgtcatctccgccgaatctgcgctctccacgtacgcttctaccgcgctgaccgcttcttcctccgtcatgccgcccacataaatattgccaatatagacaccgtcctcaatcgtctccgtcccctgtgctctcatggaaaccggtgccgccagcaatgcacaaagtgccaccgcacctccaaacaatgtcaaaaaacctgttccctttttcatattcttccctctgaaatatctgttctctgctctgctaacgcctgttttgccaagcatatactctgcttccgctcattatagcccatacgcgcctttcttttcaaggtgcataaacacgaatatgtttgactcactctgagatttttagtatattttacatgaaagcaaaacggcggaatgcgcttataataacgctgcaagcaccgttgtcagaagcatggctgccacaaccacaatgatgattcctgcaagcagttttttattcttttttttaccaaaatcgtacatttcgttctaccacctttccgttcacgccctgtataccgcgcgaaccttttacactataccacaagaagggatgattctcatgatttttttaggactttttatcttttttgtatgtatgttcgcttatctgcgccataaaagcaccgctgccgaagaagccgcagccgagagcttctggaaccgcgagaacgaagcaaaccacacacgccgcaaggacatcagcggacttccctatattaccatacctcttgccgattttccaatgggtatctatgacaatcccgaattaaaaaaatatgaggagactctccaatcgcttgccggacagaaaatcttaaacctcggcggcaagaccaacaccgatctcaaactggagtacggcgttgccaatctggaaacgctctccgcctgtgacgagaactacaccaccctctgccgcaccatctatgagtacgccgaatgtttgaaaaagctcggtcatgacgcggaggcagtccgggttctcgagtacggcatcagctgcgggtccgatcacagcggaaactaccggatgctcgcagactattatctaaacgccagggattccgccgcactcgaccgtcttctcgcctctgccagagcactggaatcccccagacagagtgccatcgtagcactgctcgaggaaaaagtaaatgcttaatcccggggcatccgcccgtgcacggcgatccagcggtcaagcagtctcgacgcctcactccgcgtcatctgctccgggatctccgtctccgggatgccgtaatgcgcagcatatttcttgagaccatccatctgacgccccgttgcgggcgtctgtttttttgtgcggtaacagagcgcatacggcagaaacgcctccggctgtaccgtaccgtactcctgttttaatctctccagcacgattccggtcgccatcgcatcatcgagtgcacggtgcgccctcgcacgcccgattccgaaataggtacacaggctttccagatcctttttctgctccgccgggagaaagcgccttgccagctttaaggtatccacggcatttcgctcaaatgtctgcctgtggttgaccgcccactgtttcagaaaactgtaatcaaaaatcacattctgaccgaccagcacatcgtcccccagaaatgtaaaaaattcctgcatcgcctcttccggttccctgccgtctgccgccatctccggcgtgatgcccgtcagttctaccacacgctctgacagttcccgcccgcactttaaaatagcgccatacgtttccgtctgtctgccgtctctgacgcgcacggctcccacttccagaatggcatccgtcttcgcattcaatcccgtcatctcaagatcaatgaccacataatcctctaacaatctattctcccctctttccggttattccccggaatactccagatattcatgctgcgcctgatgatcgagcggatctcttctggtatagtcaaatctcacatagaccggatcttccagcctctccgggagcgatgcggtatcctgtctgtgaccggaaaaccggtagaaaaaccgctcaatgtgcgactgctttccatttttaccatactgacgcgtcatctgtttccattcattcgcatctgctgcccacgcgggtctgcttccgagattctctctttcatacaggtcatataccagaccctctccaagcactgggagcacccccggcctacgctcttttgcaaattccagcaggatctccgccctgcgcatcctggaatgacccattccaaaataaccgtgctcctcataaaaagttcccagttccgcaaacatggcaaacgcactcgcatactgcgtctccagaagccggattgctgtggcgtactgtccgctgttgtaatacacctcgagcatctcttccacctgccggatgcgaaggatctccccgaaccccagccagtttgtcttaagcacctcatacggcggtctgctgcggtagatcagaccatactctgtggcatgctcatacatgtaagaaccttttagcacttttaaaaatccaagctgaagctgattgggctttaacgcgtaaatctcatcaaacgaacgcgcaaatgtctcatagccctcatagggcagacctgcgatcagatccagatgctcgtgaatattctctttttcctggatgctccttactaccgctttcaggcggtccagctgcatcgtccggtgaatctcggtgattgtggcgtcgttcgtggactgcacgccgatctccagctggatcagtcccggccgcatctgaccgatcagcgcaatctcctcatccgtcagaagatcggcagatatctcaaaatggaagttggtcacgccattatcatgttcgattaaaaacttccagatctccatggcatgttcatgcctgcagttaaaggtgcggtccacaaacttcacctgcgcgacttcctgctccagaaaaaatgccagttcttttttcacccgctccacatcccggaaccgcagtgtcttttccaccgaggaaagacagtaactgcaccggaacggacaccctctgctcgattcataatagatgatgcggttccggaaatcttcgacgcctccgtagcagaacggaatccggtttaaatccagcggctcgcgcgctccggtttttacaaggctctctccggcacggtacatgattcccttgattcccgaaagattcatcttctccgccatctcaccgatacccgcttttgcgtaactctcgcacagttccagaaaagtctcttctccctcgccgaccatcaccccggtcacctgcggatgctcctttagaaacgcctctgtctcataagacacttccggacctccgacccagatcggcacttcggggcagatcttgtggtactcgtccatcagctgttccacatagtccagattccagatataacaggaaaagcaaagcacatccggctttgccttatagattccttccaatatgtagtctatcgtatggttaatcgtatattccccgatctccacctgcgccccgccggtgccataagcctccgcataggcgcgcagatcatacactgccagatttgagtgaatgtattttgcattcaccgccgtcaacaatactttcatcgtctcacctgattcttgccctctctttttgcgcggtaaagagcagcgtccgccacttcaaaaaatgcgctggcacccgcataagccctgtcgtactccgccacaccgatgctcacggaaaacgaccgctccccctgcggcgttgtaaacattttctgttcaaactcctgccggatctgctccgccatctcttccgcctgtccgactcccgctcccttaaatatgatggcaaactcctcgccgccatagcgggcacagaatcccgccgcgcctttgtgtctggcgcagatgtctgccacttcttttaaaacgacatctccaaacgcatgtccgtaggtatcattgacattcttaaaattatcaatatcgatcaccgcaagcgaaaaacgctcccggttctcctcgtaccttctctggtaatactctaactcctcataaaagctttcatggttgtagagcttggtcagggaatcccgcttggaacgctcatcgttcacgatcgccgaatcgttgaccagttccagcgccaccagcataccgcacaccgttcccacgaagatgctgccctcaataaacggggttgtcagcgggaaataagaactggcaggtataaaatagacacagtccagcacataggctgcaacgagcagcgccgcctgcacaagcgtcatgacctggtctttgtagagcggcgtcagcagcatcggcagcaacagaaccatcggcatcagcgtcacgctcgtatgcacccacgccatcacagccgcgtaggatgtcagcaggaatatggcgcatcccgccatcgcccgtctgctgtatacacgcttctgtctgccggtcagcaggcggtacacaaaaagaagcaacagctgcagcccgctcggccgcacaatgaacagccatccatagcgcagtctgccgcagtctgcagtcggcttaaaaaacagaaacaaaaacagttctgtgattaacaccacgccccagatcttccagcccatcgaaaagaagctcgcgctccactccttccagctttcgccactcagccattcatagctgctgtcatgtctgatcttctccatcttttcccctcattacgaaacgtaatactttcttcctagaatattatactgtatcacaccgattctttcaacgacgagtaaacgcaccccgatcagaaaaaaccagagacagctccccaaccgtctctggttctatttgaaatactctccctctttttagcacatgatgtgtcttacaatcacatcgatgccggcaatccaaagcagaagcgctccgccgacatatgcttttgtcttgtgctgaaatcccagatgataacccgtatacacgccaagcacaacgaatgcaatcgtcatacatacgatgatgatcagcatcagcgcaacgttcgtccccaggaatccgaatgcgatccccgcaagcagcgtatagatgcttgtcaccgcagtcatcctcaggaactttttcacatcaaggctctcctcccggcgctcattgacccattcgttcttgattgccttcgcaatcagacggatgccgagtccgaaaaagatcaccgccgcaatcacaagtcctacaaaattctcatcgtgtgccagctcatttctgtaaaggagaccggacagatagttcccgagcgccagcgcgcaaagctgccatacagcgatcaacgcgcagatgacggacaactgttttttgtccacttttgcgaccaatgcgccctggcactccatcgccgcgaaaatatcaagcgacactcccgctataatcagaacattctctatccagttcatttccgtcctccctcacatgactccttattattatactctcttcttacaatatttccagaacaaatacggatttattgagacaattttcattagtcctctttcaccgcatctgtcttgtagatgaacttaatgcttccgttcacgccgtccgcaatatccgtgtaggtctgatagtcctcaccggcatccagaaccgcctggatacgatccatcagaggctcaatatcaccgtggtaggaatttaagatcttctcaattccctcctcgttgaaggtaacgattccgtctgccagctgatgtgcgccgtccgataactgatccacaccgtcgatcactgcgtcggtaccatcacttaacgcgttgacgccatcgttgagcttctgattgttggaaaccagttctgcacttccgttcttaagctgcgccacaccggatgtcagtgccggtaccgcatctgccagactctgggtaccattagccagtgctctcgctccggttaccagactgtatccgcccgagctctgctgctcaatacttgccgccatcgtggactttgtctgttctgccgctgacacggctgccgttccggccgctgctttcgctccggttactgctgcctccccggctgcgatcttcgctccggttaccgccgcttccccggccgcctccttcgctccggttaccgctgcctctccggctgccagcttcgctccggttaccgccgcttccccggctgcgatcttcgctccgcctaaggctgcctctccggctgcttccagtgctgcctgctttgctgcatttgcaacgccctgtgccagggtatctaccgctccgcccatcgcagttgtgattgtatttccaaactgcgctgcaatctgctgctgtgcggctgcgatctcagctgcatgatttgtctgaatctctgctgccgtctctgtcggatactgcgccgcgatcgttgcaaacgccgctccgttaatcagggtctgcacatccgcggaagatgtcagggcgcccgtcatgctgctcatattcgcgccgatctcctgcgccgcctgattcttgacctcatcatacttgccattatcaaactttgcggttacctgctgtgtcgcctgattcttaatcgcttccgcctgaccgtccactactgcctctgcctgtgtcttaatcgcttctgcctgcgcatctaccactgcagatgcctgactcctgatcgcttctgcctgtgcatctaccgtggaagatgcctgatttttaatcgcttctgcctgcgcatctaccgcagcggatgcccggttcttgatcgcctctgcctgtgcatccactgcggacgatgcctgtgtctgcatcgctgccttctcctgatcggtgaaggaagtctttaaagtattgtctaacagttctacgccgtccgcaatcgttgccgcactgctgttcaatgtgccgacaccgttagataatgtcggaatgctgtcggaaagctgcgtgataccgcttgcgatttttcccgctccgtccgtgtatgcatgaacgccggactgcagggtgccaacgccgtccttaaagtcgcccatcttggacttcaaggtgtctacgccgtctgccagttctgcggaaccgtcggtcagctgatccatcgcgtctgcgagagtatcaaatacctcatccagcttcgaggtgtcattgtcactgtcggcgctgatgaagttcgttgcattcataaccaccgtcatcgtggtatcaagcttgaagttctcaacctttgcctttacctcaacgtaatccggaatggtgacatccccgtcgaaatcgtcatcctttacgttcaggctttccttcagtcccggaagtgcatagccaaccacgacattgttgcttccgtcggagatcaccttaccgttttccacctcgatatccgagaattcatctccgaggatcatgccgctgactgccataaacggtacatagatgtcttcgtcttttccgtcaatcttcgctgtcactttctggttgttcgtgtagtcgaaccggatcgtaacctcaccggattttccggcaagctcctccggtgtcacttccttgccgtccagatagtaggtcagcttctgtgtcaccggcagctcgctctctgacgttccctggtagaaaatgtcattgccgtctgcctgccatgtcactttattgccgctttgtgtaaaggtctcatcgccttttacattttcaatatcttttaatgtggacgcatcttccagcgtatccttgtcatcgttgttgatcagatgatcggagacaatgattttctgctccttgccggtattgtcggcgatgacatatactgtctcttcttttccgatctctttctcgcttactttgcttccgttatccagcagatcctttaagctgctctcggcatcttccgtatcttccgcctcctcagaaacttccgtctcctccacggtctctgtggcagcgctgcctgcctttgccgcattcacactgtagacggaggaacctgttgcaacaagcgtaacgaccaggactccggcaataatgcggattgcatatctatttttgaattttgattttaactctggtaatttcatggtttttaccttcctttcccgttactgtaccgatacattgttttccgacacattcaccgtcgtgccctttttattgcgaaatcccatgctcgtcgcacagatcagtttatcaaaaatcataaacatggacggcagaatgaaaataacgacaaacatactgatgattgctccgcgtgccatcagaatacacagggaactgatcatatcaatattggaatacatgccgacaccgaaggtcgctgcaaagaagctgagcgcactgacaatgatcgactggatggagctgcggagtgccgtcgcaatcgcttccttcttgtccgccccgttgtagcgaagcttcttgtactttgttgtcatgagaatcgcataatcgaccgtcgcgccgagctgaatcgtaccgatgacgatagaagcgataaacggcagcgtcgtgtgcgtatatgccggaatacccatgttgataaaaatggcgaactcaatgaccgccaccagaatgaccggcagtgacactgacttaaataccagtgcgataatcacgaaaattgcaccgatcgacacgatgctgactgtcttaaagtcctgatctgtgatctcaatcagatccttcgtacacggtgcctcaccgattaacatggcagaggaatcatattttttgatgatattgttgatctcctcgcactgcgcgttcacttcatcagaagcaaccgcatattccgagccgaccaccatcatctgataatcgccgttgatcaagacgtcttttacgtcatccgggataaactccctcgggatgcctggtcctaccagcgagtcaaagccaagcgccatcttcacgccatccaccttgctgatctcatccaacattgcgctggcatcttttgcggagagactgctgtccgcaatgatcatgtgcgtcgcacccatctcaaagtcttcgtttaacttatcgttcgcagtaatactgcttaagctcttcggcagtgttcccgcaagatcgtaatacacatccgtgtgtgtgtagccgtagattgccgggcccaacaccaccagaaatacgatcaggaatacgccgtaatggcgcacgatccagtctgcaatccgtcccagatccgggatgataaccttgtgcttcgtcttctcgatcgccttgtcaaatacaagcagcagcgacggcagcaccgtaacgcagcagataacgccgagaacaacaccctttgccatgacaattccaagatccataccaagtgtaaagctcatgaaacacagtgccacgaaaccagccaccgtcgtgatggagcttccgaccaccgatgtgatcgtattagaaatcgcatgcgccatcgcacgttttttatctccctgaaaacgcccctgctgctcttcgtaactgtgccagaggaaaatggaataatccatcgtcacacccagctgtaagaccgccgcgagcgcctgtgtcacataggaaatctctcccttgaaaacattggtacccagattgtatacaatcgccattccgatactgagcaaaaagaaaatcggtgccagagccgaatccatcgtaagtgacaggacaatgactgccagtacaaccgcaatcagcacatagaccggggtctccttgttcgacagattcttgatatctgtaaccactgccgacataccgctgatatagcactgatcttttaccacaccgcgcagttcctcaatcgcatccatcgtctcgtccgcggacatcgatgtatcgtataacactgcgagcaaggtgctgtccttctcatcattattaaagaaatcatagatctcatccggcagcatctccatcggaatgctgatgtccgccagtgaatcgtaccagatcactgattttacgtgaggaacttcctccatctgctcccgcattgcagatatgtccttcgcgtccataccctccactacacaaaacgagaatgctcccgttccaaactcgtcaagcaggagatcctgccccttcatcgtctcaatctcttccggcagatatgtcaggatatcataattcactctcgtgttaaaatatccgattgccgacggtatcaataagaaaatactgagaatcaaaatcggtattcgcagcttgacgaccgcttttccaaatttaatcatggtccctctctcctttccataaaagcattgtataaaaaaaagactgaatatgaaaatattcaatcttttctccgtgtatcgggttattatacactcgacccgaaatgtataactatctatacatttatattcatttgtattctgtccgcaattacagttctgtcagaatatccgtcatcgaccgcttgatcatgtaattatagatttctgcaagttccttggatgaaatcgtcattccggacttgatccaggtgatcaccacatagcacatggactgtgcataatactccgcgatacgctctggtgtcagccacacgtaccggctttttctgccctctgcctgtcctttgatgacctgtagcagcacgcgctccacacagctttgtgcaatgctgccgaatgaattctgtccttccagccggcttgccttcgtgtagaactccttctcacgctcgatcccgctgaacagaagcaccagcgcctcgttgatcatcccgttctggatcagcggttccaccggttccagcagttccttgtcgataatccactccagcagatcatatttgtcctgaaaatgattgtaaaatgtcgggcggatcacgcccgccttatctgtaatctctttgattgtaatcttctctatcggctgctttaacgccagttccttaaagctctctgccaaaagtgtatcaatcgcactctttccctgtccagtcataactccctctcgccccaggtgctctatcgcactatgagtctcccaacagttaccgccctcgctttttcatcgtcacgcatgttcaacatctctcccgtctccacaacgcgcaccagcggacgcagcgggaaattctcaaaattccgtgccaccaccgcatgctgcccgttggacagttcgacttcgcagccgatcggatacgccgccactttccttgcgaacacagccacaatatccgggtcaaaccagcggtcgcccagcgccatcacatattctaacgcctccgacggcgacagtgatttctgtgccggaaacgcggaaacctttgcgtcataacagtctgcaatccggataatgcgggcaaacaggtgaatctcgccgccctttttgccaagcggatacccttcgccgttgtagcactcgtgatgctccatgattccctcatacacatccgcggaaaatcggcatgtctcgcgcagatattccgcaccgatcttcggatggctccgatagacctcctgctctttttcgctgcggtgcgccttacctccccgcacgatgtcatgatcgataaaccgcttcccaatgtcatgcagcagcgccgccgctgcaagctggcacagctcatcatgcggaagccccagccgtgcgccgactaccacagaaaggatgcccacatgaatggaatggtaatagatataatcatcataactcttgatgtccatgatattgcacatgatgtctccattgcatatcacatcatcgaccacagactccaccgttttgcgtagcttaaactccgcttccgacggttcctgcttccgcatatccgtgtgaaacagatcatatacaattttcagtgcctgcctccggacttccgggctgacaatctgctgtatctcaatccccctggaaaactcatcgtccacgtagacacccgggaacccaaggaattccagatttgaaatttgttcttctgtcagcagaatatgccttcccagaagaagtcttcccgccccgtcataaatgtcctgccccagtgccattcccggcgtcagtctgctcgtcggtaaataacgcatttgtgcttcctttccgctaaattattattattttagcgcttttactcatcaaattcaaccgtaacaaaatatcccttcggggtctctttgacgtctaccactgtgccttcccgcgacttgatgcgctggcttaccacatagttcgccgacatcgcgtacgccttgcccagtgtatagtaataggaattgggcagcttcccctctgtaatcggaagcacatcgccgacctcaagcagtccggtgcgctccattttaaactcttctctccgcatgaaaatatccctgtttctatggcttttctatgtgttttccactattgccatgcatttttcattatagtataataattctgaattctcaagatgttttcatttaccatatacaaaggagccttatgagcgatcaaactgttctcatcgatcaattcctgtcatccgtcatcggcacgattcacccggacgaaatctttgattctattatagacacagccgtccgtctgctgtctccggacggtctgctactcacgatccgtgacgatgtcagtccttcctaccacgtcacgcgcagttttggcgatatctcctgggaaaaagattcttttctcgattcgagcattcttttagagcagctgttaaacgccgacagctacattccgtttatgccgggcgcaggtctgccgaccgcgcttgacggcgtttccagccatacacgcagctggctgatccggcagaatatcatcggtgtctattgtctgaagtacaaccgggcactgatcggctttctcttcatcgcgctgcacaatcacatgccactgtctgcagatcaggtgtccgcactgtgcaagatcggcttttatgccacccacgcactgcgcaacgcgaatctctacatgaacgcctaccgggcctccatcacggatgatctgacggcgctctacaaccgcaagcatgcgtttgagatgattgatgagctctgcctctccggtacgccgtgctctttaatcatgctcgatatcgatgatttcaagctttacaacgaactttacggctccaaagagggcgatcacttaatccagcgctgtgccaagatcattctctctgctctggatgcggacgacatggcattccgtttcggtgtagacgaatttctcatcttaaaacgcggcagtgatgccgcagccgccaaagcgtttacccagtctctcgtggaagttctgacaaaaggcagcatgcccgacatggtgtgggaaattaccatcacctgcggcatctccgtgtttccggatatttctgccgacggcagagagttgatccacaatgtcgagcaggctgtctattttggaaagcttgatgggaaaggccatctcatcgtttaccgcaaaggtcttgagaaccgctcccagaatccggatatccgcaccgcctacgagcgggtggcgccgaccatctatgcgctgaccgccgccatcgacgccaaggataattttacgttcatccattccatgaatgtctcaaaatatgcggtcatgctcgcggaagcgcttcatatgaccgacaatgatatcgaggtggtacgggtcgcaggcatgcttcacgacatcggcaagatcagcatccccgagcacattttaaagaaaaccgaggggctgacgccggaggaatacgcaatcatgaaaacgcatgtggagaattccatcaagatgatccgttaccttccgaacatggattacgtgatccctgcagttgtcgcccaccacgagcgctatgacggaaccggttatccccgcggattaaaaggaacggaaattcccctcatgggacgtatcttaaccattgcagactgctttgacgcgatgacggccagacgcccctacaagcaggaatgctcgatcgactacgcggcaggtgaactaaaaaagaacagcggcacgcagttcgatcccgaactggtgccggtgtttctgtccctcatagaggacggaaagattgcggggtgaaaatccgcaccaggtacacgtctgcctttcagtgataagtaatattataggaagcacacatcgtgggatttcagctggaaatacagctggatattcggttcataaaatgtggcatttctaaccagccggatgtttgcatccacgatgaataaaaaatattccatcgtttatagcagcttaacaggtaataccaaggtgctggctgatgcaatccacggggcattacctcaggatgaatgtgagtatttcggtgtgtccgacacagtgatcccttcttccgaactgctctatcattgacgcaagcaatgttatcgtcggagagtatatgtgtcagggcagaatgccgcagtctgtctgggaacgctacttgaaaatgaaggaagctcctgctcatccggcaaatcttgatgtattgatccagaattttgactgtgcattgtctcaccctgatgccaatgatctggaaaaactgaaagaagccgttatggatccatccttctgataagaccataaaataaggcagccccgcatagctgagtctgccttactctctttatttaacgttgatgccactgacatattgctgcagaaactgtttctttccacatggtcttccaaaataatatccctgcagataatcaaccttcatttctttcattttcagaagccattctttttcctcgatgccttctgcgcatatcctgacgttaatactatgtaccatggggatgatatttttatataattcataatccctgtcactgttcatcgccttggcagtaaaatccctatccattttcacgtaacttggattcatatcacggatacaatgaagattcgaatatcctgttccaaaatcatcgatcacaaagggaatcccgttcttgtccagaattttacgaaatttgcagaacgaaggtgtcatatccataaatccgctttctgtcatttcaacacataagcattccggctgtaatgaatatttttgaattgcatccagaatatcccgctccacattgccttgcaggatctgaacataggatacatttacattcatccggaagtcaggaatatatttctgcatttcacagcacattgctgcagcttcgttcaaaatatatcttccagcgggaatgatcaatccggtctcttccaataatgggataaactccatcggtgaaacaaactcccgcccttcttccgttatcatggaaaaacgcatcagtgcctctgctccaatgatctgttcggactgacagtccacgatcggctggtagtatacttcaaagccatcataatggttcacaatagcattacgaagtgttgctatgattcttccttttcgtaaaaagacctcatagtcatcctggtcaaaaatatagaatccatttttacccatgctttttgcctgtttcaaggcaaattcaaattttttgcggcattcttcggttccctcacaaaatgttgctgcatctataacaccaatagaaatagaaaatatagcttcataattttcggctactatgaaattacgaagtttatctgtaatcttttctttcagtgccacagcgtcttctgcggaggaagcttccagatccacgatcacatactgatccgctaccagatggtaaattctctgcttgtctgaaaggcattccttcatacagccggctacgcttttcaggatataattaccataatcagctcctctggagctattgatcgctccaaaatcatcaattcctacatgcataaaaaatcccttggtaatgggttctttttgtgcacgcaggtaagcaaggaattccggaccgccaagcagtcctgtgacattatcggctcttctcttgttgccggtctcattcagacacccgaccagatactctgcctttccctgctgatcaatgatcacgataccacggcagttaatccagaccggcataccttctttatcaagccacctgtaatgaagattatgtaccttttctcttccttcgcatatatccgcaagatgctttgcaagcatcctgcggtcatcctcatatactaccttcataacttcatttgcagcatctgtcagaacactttccgacatattaaaccgattcacagctgactgtgaaatctcaaaggtattatcctgcagatcaaatatatacagataatcatccatacattccgtaacgatctcaaataagatttctgctgtctgctctccaaacactttaaatatatcattaatcacaacaagaaccttccttacgacagcttcactctattcctgccatttttctagaatagcttaaagatattcacgcggtcatgcatcttggctgctccctctgccagattaatactgatcgcagtattctcttcggaggatgcagcattgccctgtactacgccggacagctgttcaattccctgaccgatctgctccaaggactctgcctgggagttggctttctccatggtgttctctgcaagctctgcaaaggacttcatatcttcaatgatctgattgaatgattctgctgttgttcttgtaatcgtattgcccttttcgatttccactaaggtcttatcgatcaactctctcgtatttacagcggattttgcactgtctgctgccagcttgccgatctgatctgcaaccaccgcaaaacctcttccagcttctcctgctctggcagcttcaatggaagcattcagggataacaggttggtctgggatgcaatatcctcgatatctgtgataatattaccgatctccttggagatttctgtaatgtactccatttccgtgagcagctcattcattttttctttttcttcgttcgctttatttgcagaggcttttacacgtgcagatgcgctctgtgtttccttcgctgtatcttctgccagatccacgaccgcatcaatggtggcattcaattcctcgatgactcctgcctgctctgttgcaccgtccgccagggattttgatgcattttccacctcggatgaattcgatgatacctgttctgccagattgctgatctcggtcaaggtactgttaaaccgtttcagaatatacagcagtgatgtcttcaattccgagaaatcgcctaggaaatctgtaatatcatcaccatttctggtcaggtcaccctgcgctattgcctttacctccacagagatctcgctgacataatctgccagaatacccatggcttctttcagattcctgatggtatcgccaaactcatcctcagactcataggtaagcatttctacattagacagttcgcccttacgcaggctggcaactgctgcctctatctgttctaccggctctgtaatggaattggtaatgatccttccgatcagtgtcgtcactacagcaatcgcaagacccgctgccacgatcacaataaatatgattacagtgcatacattagccatggtctttgcctgatctaattctacctggaacttttcacataatgtagttaatttctcagcaaaagccttatattcttcatacacctctccggtcatcagcttcgatgcttcctgctgtttaccttcacggctcaactgcagaatttcatctgaagcagccctgtatttttcccatgcagcgtttgctacatcataatcatcccgtcctttttgagctttgctgtctgcagaaattattgcatccagcttcgcaccggtatcctcgatctgactctccagcttctggatttcttcttcgcaggagttcatgactgctgcatctgattctactagatgctgatactgtttgattctgtatttcgcagtcattgtctctaaatcctgcagatattccaatgacggagaccagacctccgtgatcttctctatatttaaacggatcactaatgtcgagatcagtgccaccaatactaaaaataatgtcataacaagcactgtcattcgatatacttttaattttcctgcaacctttaagttagttatacgctttttgatcttttccatgatagttttcccttcctttgtaaattattgttctttttatcacgtatatctatccatatatcgtactaagatagcatactttattgggaaaatctattactaaagtattaaattactcaaacttcgcacattaaaatgtgcctatgcaccttgaaaattcaataataactggcataaaaatagcatgaaaccaatggttttggtataattgagttgccaaaaaaacaattacaaaccggagactcatgctatgaataaaagtataacacaagcgcctcaaaatgataagcagatttctaaatctatcaaacgattttttacaaggtttcatatttcctcagccttgaaagctgccaatgcctataaaaggaaaggcactccggtaacggagatttttcaatacatgtttctgctgattttctccaacagaagtatgtatatgagtctgcttacaggaaaaaacacacctaattttgcaaaagctaccttaacttgagcagagaatgtaattctctgtcctatgatgcaatgactgcgcataccgcagttgttttcacccgatatatgatgctgtcactggaaagccgggaatccaatgataaccggtcacttggggagctctttttatacttttctgacgaaatgtctgatatcacatggatacaggcttttcaaatgctgcttcaaatgttcagaacaatgctttcagataacactgaactttcagacgaaaaaatcaatgaattggcgaatgcatttatggatgcacttcctactatgatgaaaatacgactgcaggctgcataaaggctgaacactgacaactaaataactgccagatattgaattttcaaggtgcatagctaaaatttatgtgcgaagtttgagttttataattaaaaaagagaatgaaggaaaaagtaggaaacaagccaaaatagccggtttaaataagtttttgcaaatctattatgcaagagtgatggaaatatataagaatatagcatagttgcataagaaaaaagcctgaataatcaggcctatttcttatgcaaaaaaaattaaaaattgtgttgacatctcttaacaaatctaaaaagtccgcccattgtctccggtgtgccggacatgcacccgttggattgtccaaacgtggaagagacgctatcttatatctctttatagtctacatccacggcttccgcttcctgcttcatcatctttgccgcatgcacggcgcggtttgccacccacagatccgagataccgtcatagatcagggcaattccgataaactgcagtgccagctttaccatgccgaacgcattcacgatacagagcacaccgaacaccaggctgaccgctgcaatgattaacatgctccaccatttctcataaccgttgcgcttcgtttctatcgcaagcttcagatcctggattccatgtacgcagaggatcacgccgatcacaatcgggatcaggctcacaatgctctccgggcgcaggaaaatccagattccgattaacaatacaatcagtcccaatgctcccgcaaacggatgaatactgcggttcataaaataggatgcgatgtcgacgcctcccataatgatcaatccaacggcaaggattttgcagaatacatcgatcgtctcagccggccataccagaagcacaatgccaagtgcaatgcaaagcagcgccgagactatgatgtctgccttgatccgctttaatgtttctttcatatcacatacctctctgtcactttttctgcattatactctattcaatccacagtttcaagaaacaatgcggcggctttgtctattcccattcagcccgatctgtcccgcttgactttttttcacaattccactagactatgggcacaatgaatcatatgtcccgccgcagtgcaatccacgcggagcgtttttccttcacaggacatattttccggaaagaaacaaaggagtgaatattttatgggaaaagaagtaaagacgaatgcgatgcgcattcttgataaaaataagattccgtacgaaattttaaattatgagtgtggagaatttatcgacgggctgcacaccgccgaggcgaccggcgctccggtggaacagtccttcaagactctggtgatgcagggaaaaagcaggcaatactatgtgttcgtcatccccattgcggacgaggtggacttaaaagccgccgccagagccgtcggcgaaaaatccgtggagatgattcacgtcaaagacatcactgccatcacgggttatgtccgcggcggctgctctcctctgggcatgaaaaagcagttcccgaccatcgtgcacgagagcgctgcggcttttgacaagatctacatcagcggcggacgcatcggcacctccatcacggtcaatccggattccctgcttaccgtggtgcgcggccagtatgccgacgtcatccggcatgagtaagttcttcttccatctcctctaagatgtggagcagatcacgtatctgccttggatttcacttctacggtcttctgtgcaatatcagtcgttcccttggcaccttcgttcgttgccgttgcaattccctccatcgcatccagcacgccatcaatcgatgccagaagctcctcggatgtcgcgctgaaatcgctgatcagtgcatcgatctttccggcatcctggttataagcgtctgccacctcatcaaacgtatcatagctcgccaccacatcatttccaacaaaggcaagcagctgctccgcatcagaagaaagctgtgccacagaagatgtaacttcctccgtcaccttctgtatctgggcaacctgaaaagatctgctcagtgaaaacgccatatacagacagaccgccatgacaatcacaatcagcagactgcccgttccgataatcgcgatcagtgccgtttttacattctcccgcattgcctgcgtttctttctcaacagtctcatcgatatagtcaatatagtttcccgttccgacaacccagccaaacggctcaaatgccctgctgtaggatctcttcggagaagattccgtctcaccttctttcgggaatacataatccgtatatccgccgtccggttcctgcccgacgcggataatctcttttaccatctggtaaccatccgcatccttcgtctccatgcggttcgtcccttccgtcgcgcttccaagcagaaccacattctctccatcataggtatctgcccagaagtatccgccgtccccgtacctgagttcccgcagcagatctgcaccgcgtgtttccgcttcctcataggaataatcaccattctcatagcctgcatacaccgcatccagcatggaaatcgcattatctacctgattcttaatattctcatcgtaatcttcttcgatacttgcgcggagaacactctctgaacccctctccataatcagaatccggtttactgacagaattccgatcgccagtgttccgatcagtgtgatcagtgccagaataatcatcttctaacgtacactcacatttttcatacctatccgactccttcctgtgcttacttcttttattatcgtatattccccactaatcgtctatatttgttaataatttagcaatctattcatgttttttgtcaatattgcatatatgtaaaaacgcaggactcctcttttacaatcacagaagtctgtctaaagacattcacccgcaacgcagttacactaaagccacaaacggtgagcggcacatcagaccgccactcatacaaccagaggggaaccgggtggggccggtttccacactaagaaaatggagggactttacatggcaaagtacatcatggcactcgatgccggaaccaccagcaaccgctgcatacttttcaatgagaagggtgaaatgtgcagcgttgcccagaaagaatttacacagtatttcccgaagccgggctgggtagagcacgacgcggaggagatctggtccacacagcttgaagttgccaaggaggcaatggcaaatgtgggcgcgactgcagccgatatcggggcaatcggaattaccaatcagcgcgagaccaccatcgtatgggataagaacaccggcgaaccgattcatcacgcgatcgtatggcagtgccgccgtacttccgaatactgcgattccttaaaagccaagggactggttgataccttccgccagaagacaggactggtgatcgacgcctacttctccggaacgaaattaaaatggctgctcgacaacgttgaaggcgccagagagagagccgagagaggcgagctgctcttcggaaccgtggagacatggctgatctggaaactgacacagggtcaggttcacgtaactgattactccaacgcttccagaaccttgatgttcaacatcaataccctggagtgggatgaagatattttaaaagaactgaatattccaaaatgtatgctgccggaaccgaagccatccagctgcgtgtacggcgaagcaaacccggtattcttcggaggcccgattccgattgccggtgctgccggtgaccaacaggccgctctgttcggtcagacctgttttaccgccggtgaggcaaaaaatacttacggaaccggctgtttcttacttatgaacaccggcgaaaaacctgtattctccaagaacggactggttaccacgatcgcatggggtctcgacggaaaagtaaactacgcactcgagggttccatcttcgttgcaggtgcctccatccagtggcttcgcgatgagatgcgcttcatcgattcctctccggattccgaatacatggcaagaaaagtcaaagacaccaacggctgctacgtcgtgcctgctttcaccggtcttggtgccccgtactgggatcaatacgcacgtggaactatcgtaggcattacccgcggtgtgaataaataccatattatccgtgcaaccttagagtctctcgcttaccaggttaatgatgtattggctgcaatgaaagcagattccggtattgatcttgcagcattaaaggtagacggcggagcaagcgcaaacaatctgctcatgcagatgcaggcggacatcagcaatgctccggtcaaccgtccgatgtgcgtggagaccacagccatgggtgctgcctatctcgccggactggcagtcggctactgggcaagcaaagaggatgttcttcagaactgggcaatcgaccgcaccttcacaccggagatcaccgacgaggagcgtaacaagaaagtccgcatgtggaagaaagccgttacttattcgttcaactgggcgaaggaagactaacacacaatttcatatctaagagggggtatttattatgacaccatatattgcagagtttgtcggcaccatgatcctcatcctgttaggtgacggtgttgttgccaatgtcaacctgaacaaatccggcatgaaaggtgccggtgcagtccagatcacacttgcctggggtcttgccgtactggttcccgcctttatcttcggcgcggcatccggcgcaagctttaaccctgcattgaccatcgcgcttgctgctgacggcagttttgcatggagcatggtaccgggatatattgtggcacagctggctggtgctttctgcggcgcatgccttgtatatctgctgttcaaagatcagtttgacgcaacggaagacgcgtcaacgaagcgcggcgtgttctgtacggcacctgcagtgcgcaacatcccgcgcaatatcttaagcgaggctgtcggcacttttgtactcgtatttgccatcaagggtctggcacaggttccggatctggcggacggcaccggaaaatttctcgtattcgccattatcgtatctgtcggtatgtctctgggcggtctgaccggatatgcaatcaatccggcaagagatctgggtcctcgtcttgcacatgcagtgcttccgattcagggaaaaggttcctctgatttcggatacggactcgttgttccgatcgtcggaccgatcctcggcgcattggctgccgtgctggtatatggacttattttttaaaactatagattgaatgtcagagaagagagccaggcagaaaacacatcagaaatgatgtatgatctgcatggctcttttaaggaggaaaaactatgtatgatgtagtgatcattggtgccggcgtctctggaagcgcctgtgcacgtgaactttccagatacaatctctccatttgtgttgtggaaaaagaggaggacgtctgctgcggcacttccaaagccaacagcgccatcgtccactccggtatcgactgtaaacccggaaccctgatgtcagagatgaacgtccggggaaatgaactgatggaaccgctctccaaagagctggattttgaattccgcagaaacggttccctgatcgtctgcttctccgaggaggaccgcccgaagctggaagccctctacgagcagggcatttccaacaaaatcccggatatccggatcttagatgcacacgaagttcatgagatggagccgaacctctccgaggaagtcatcgctgccatctactgtccgaccggcggcattgtctgcccgttcggtttgaacattgcactcgcagaaaatgctgccacaaacggcgtcgaattccgttttaacacagaagtgacagacatctgccgcaaggacgacggctatcaactctccaccaaccgcggttacatcctgacccgctgcgtggtaaacgctgccggtgtgtatgcagatgtttttcacaacatggtcagcagcaagaagatccacattaccccgcgccgcggcgaatactgcctgctcgacaaaacaaccggcggtctggtcgacaagaccatcttccagcttccgggcaaatacggcaagggcattcttgtaaccccgacggttcacggcaatacgctgatcggccctaccgcagacgatcacgacgataaggaggcaaccaacaccacccgccagggacttgaccatgtctgcagcgcagcaagacgctccgtgccttccgttccggtccgtcaggtaatcacgtccttcgccggaaaccgcgcccatgaggacaaccatgaattcattattgaagagttggcggatgctccacactttgtcgactgctccggcatcgaatctccgggcctcaccagttccccggcgatcggcgagcgcgtagcgcagattgtatccggactgcttcacgcacagaaaaacccggcatggaacggcagccggaagggcgttctcaatccgaaaacactctccgaggaagattatgcggagcttatccgcgaaaatccagcttacggaaatattatctgccgctgtgagatgattaccgagggagaaatcttagacgccattcaccgtccgcttggcgcacggtcattagacggcgtcaagcgccgtacccgtgcaggcatgggacgctgccaggcaggtttctgctcgccgcgcaccatggaaatcctggcgcgtgagcttggtatctcccagcttgaaatcacgaaaaacggcggctcatccaacatggtcgtcggcctgagcaaagacagaacctgaaggaaaaaggaggattattatgacttcatatgatattgtgatcgtcggcggaggtcccgccggtcttgcggcagccgtttccgccaaaaataacggcatcgaccggatcctgattctcgagcgcgaccgcgaactcggcggcatcttaaatcagtgcatccacaacggtttcggccttcacacctttaaggaggagctgaccggcccggaatatgccagacgctttatcaatcaggctctcgatctgaacatcgaataccgtctgaacacgatggtgatggatatttctctggcagaaggctcttccgataagatcgtgacggctatgaaccgcaccgacgggctgttccacattaacgcaaagaccgtgattcttgccatgggctgccgcgagcgttcccgcggagctttaaatatcccgggctaccgtcctgcaggcatctactctgccggaaccgcgcagcgcctggtgaacatcgagggctttatgccgggacgcaaggttgtgatcctcggctccggagacatcggcctcatcatggcacgccgtatgaccttagagggcgccgaagtcaaagtcgtcgccgagctgatgccttattccggcggtctgaaacgaaacattgtgcagtgtctggacgatttcggtattccgttaaagctgggccatactgtcgttgacatccgcggcaaagagcgcgtggagggaatcacactggcacaggtggatgaacacaacaagccgattcccggcacggaggaagactacgaatgcgacacactgctgctctcctgcggtctgattccggaaaatgagatttcccgctctatgggcgtcgagctaaatccggtcacctccggtccttctgtcaacgaaagccttgagacaaatattccgggcgttttcgcctgcggtaatgttcttcacgttcatgatctcgtggactatgtatccgaggaagccggcgttgccggaaagaacgccgcaaaatatatcaagtgcgggggcgatcatgctgattccggcaaagagatccccatcgtcgcaaccgacggcgtccgctataccgttccaaaaacgctgcatgtcgccaatatggacgacgagctgaccgtgcgtttccgcgtcggcggtgtatacaagaactgttatatttccacctacttaaacgaccagcggattatctgccgcaagcgtcctgtcatggctcccggcgagatggagcaggtaaagctgcagaagtccgttctggaagcaatgagtgacctggatcacattaccatcaaaatagaagaggaggcgtaacacatggaaacaagaaatcttacatgcatcggctgcccgctgggctgtgccatcacagttaccatggatggcggaaatgttgtctccatcaccggaaatacctgcaagcgcggctctgactatgccgcaaaggaagtcacacatccgacgcgcatcgtcacaagcaccgtctgtgtccgcggcggctccatcccgatggtatccgtcaagaccgcacaggatattcccaaagaaaagatcttcgagatcatgaaatatatcaacgcgctgacggtgacggctccggtacacatcggagatgtcctgctgaaagatattgcaggaaccggcgtcgacctgatcgccaccaaagaagttctctcttagaaccgcagatgcagctgcaaaagtaaaaaagtaccggtaagccagaccagcttaccggtactttttaattttgtcagaatagcattacaatactgcggtgcgcgggagcaatacggcaagccccgcgtccgtttttgcaatcgcccgcatcataaactgcacatcccgctttacctgttcccccgataacgtttttctgtaatatacaaaatcaatcatatagtagcagatggatgtggaaagaaagctcgtcaccgcctccagttcctcaggatgcttttcaaacatgcccggattctcgccaagcagcagacggcgcacctgcgcatccaacgccatgcgtacaccacgcacgatcatcggccacgcgagctcgttcgccagcttctcataaaagctgcgctccctctgcagcacctccatcagatcgcatgcccacttttccatactgtcatactgtccctgcagctgatccttaaagtcattacagccgatccactccagcacatcataaatatccttaaaatgataataaaaactctggcggctcatccccgttgcctccatgatgtccccgatcgtaattttggatatctccttgcgcttcatcagctgcctgacacaatccgcaatttttttcttagttgaataacacatacccgtacccccttctcctgatacactgtatccgttacattttccacactgcctggtttgtcgttgaaatcgcaatcgctcccgcatccagtgcccgcatgacgtcctccttctccgagatcagacctcctgcgatcaccggtactgctgcctgccctgctatatgctttatgattttaggcataatgcccggcagcacctcgattagatctgcaaactccataccgtggtgttccagtcctccaatcgccttggaatcaatcgcaaatatgcgaaataccgtacagagatccagctccttcgcataacggatcatttccggctttgtggaaataataccgtccgccgccgtcccataccgtataaaacgcaccgcttcctccctgaccgcaagccccccgatcagatccagatgtacaatgacaaactttccggcatcttttaaccgctgcacaatatccgggatggtaatcaactctccatacaaaatgaataccacgcggatatcattctgtatacagacctccacccccgtctcgtccttcaccgccgcgataatcggtccgtccacaatcgcgtcataaaattgctgcttcatcttttgtctgcactccccccattctcccctgccgcatcatggcattcctggcgcatcatttccataatgatatttcccatagcggaagtcaaaaaatcccgcaagctgcacattctttatttcttcatagggcgtaatttcctatgaaaaaaagcacaccgacagagtaacatttctgttattcccggcctgctctttcactcttggctcacactatagaattgtatgcaaaataccgtgtaatttctttctgacattattataactatgtcaaaaaggaaacgcaaccgaatttcagattttgcatttgacaatttcagcgttttgtcaaaaaactcacatcggattctcaaggtattccgccagcacctgatataaccgctgcggctctaccggctttgcaagatagtcgttcattccggcttccttacaggcatccatatcctcgcgtgcatcttttgcactcatcgcaataatcggaatcatctacgcatccttgtgcgacacccgtcggatctgccttgccgcctcaaagccgtccatcttcggcatcacaatatccatcaggatcgcatcgaaataatgcgcttccttctccataaaaagacgcaccccgattcccgccggacatgcgtctcttattgtatctttatgtatgccttcgtttcgatatgacatatatgccttcgcttcggtatgccttagcttgtcatctctgtgccgtcataacgtgccagatccatgatcttctgaagctccgctccctcaaccggcgcctcgcccagactctcatgcctgccatccggcaggatctgtcccaatgcgcgcacttccttctccgccgtcatctcaatcgtgtagtaacccgctttcttcgtctgcggattaaacgtaatatagatacgatagcaaagcggggctgccagtgctttctccggcagatccacgcggatcagtgtcagatcctccgcaatgtcaagcgccataaccgaatagtctgcctctgtgtacggatagagcttcggctccttatacgtctcggcaaaaatctggttcacgaacgcctcgcgctcctcacagagcttccggacaaacgtctctccctctgcatacaggcgcttcggcagaactccaaactccacctgctttttcacaaacacgttaaactgctgcggtgtcatcttcacctgccgcatctgtgccgccttctgatctgcctcatgcagcttccgtacaagttcggtctttaatacaaggttatccgagaacggattgatgaccagcccggtcagctccagttccggcttcacgacgatgttgttgcacgccgggaacggcatgaaaagaagtgcctggctcttcggctcctccggcatctgctccttggaagtatatgccacaaaaaactgctcgcccttgttgttcttgaggaaacacggggtcggctgatccggcgccttaagcattgccggcacatacagcttggtcggacgaagcaggtttaacaccgtggtaaggttctccttggtgcgctccgccgcatactgcttaatcgcttcctctaatctatcgttggtgatctccattgtcattttctcgtccatcttataagtatcctttcctatgctccgatgtcgctaaaatgaattatatcatatctttcccataaaatgaactgttttctaatccacaacaaagactgagatatcctgtgtcagacgctgtgccgtctgatcgcatctgccaacttcatctgtgaccgtatccgcctcggatttgacttccacggtcttttgtgcaatatctgtcgttccttttgcaccttcgttggttgccgttgcaattccctccatcgcatccagcactccatcgattgatgccagcagttcctccgatgtcgcgctgaaatcgctgatcagtgcatcaatctttcctgcatcctggttgtatgcatcagccaccgcatcgaacatgtcatagcttgccacgacatcatttcccacaaatgcaagcagctgctccgcatcggaagaaagctgtgcgacagaagtcgtaacttcctccgtcaccttctgtatctgggtaacagtctgcttggactgatctgcaagtccgccaatttctgttgccacaacggcaaatcctttgcctgcctccccggcgcgtgctgcttcaatcgaagcatttaacgcaagcaggtttgtctggtttgtaatctccatgatcgccgatgataacacttcgatctgctgaactacctttgcagcctcaagtgcctttgtaaggctctcccgtatctcattgtggatccggctcgcatgctcacgctgttctctggtatcgttctgtgcctttgatgcccgctcgtgtatatctgctgcctgctgtgccccatcctgcgaacgatttgcaatattttttgctgcctcttcaatctcaagagacatgctcttaatcgtatccgaggatgccgcggtctcctccatgcttgcagcaagttcctctgtcgttgcggaaacgtcctcgatattgccgttcagcgtaatcacattcgtcttgaccgtatcgacgacctccccgattacataactctcatttttcacttctctgataagatctctgatctggcacttcatattctcaaggcgctcgccgagaataccaaagtcgtccctgcggttctcaagctgtaccggcagcggctgcgaaaaatcaccctttgtaatataaccgatgtacgtgagtgcaacctgaaatgatttgctcagtgaaaacgccatataaagacagaccgccataacaatcacaaccagaaaacttcccattccgataatcgcaagcagtgcactttttacattctccttcattgcctgtgtctctttggcaacagtctcatcaatataatcgatataattgcccgttccaacaacccatccaaacggctcaaatgccctgctgtaggagcgcttcggagaggactccgtctccccttccttcgggaatacataatctgtataaccgccgtccggctcctgtccgacacgtataatctcttttaccatctggtaaccttccgcatcctttgtctccatacggtttgttccctcggtctcgcttccgagcagaacaacattgtctccgtcataggtatccgcccagaaataaccaccgtctccataccggagttcccttaaaagatccgctccgcgcgtttcggcctcctcataggaatagtcgccgttttcatagcccgcatacaccgcatccagcatggaaattgcattatccacctgattcttgatattctcatcataatcatcttcaatacttgtacggagaacgctctctgatccctcctccataaccagcatccggttcactgccagaactccgatcgccagtgttccaatcagcgtaatcagcgcaagaataatcatcttccaacgcacgctcacatttttcatacccatccgactccttcctgatagttatttcttttattatcctactttttcatttttttgtctatagatgttaattattttgcaatctttccccgttttttgtaaatattgcccatatatcacttacagataacgcgataacacttacggaaccggatgattcttacatatgagtaccgtagaaaagcctgtgttcttctggaacggactgattcccacgtccccgggctgacagcagatgtcttccacatgccagcacccctgcctcttccattgcgaagaagcaggggtgcgctttttgtttctatatgtttttaaaaacagtacctgttacaccgtttttttatcttctgcaactttgaatttgcggatcatttcacgcagactttccgcctcactgctcatctcctggctggcagccgcgcattcctctgatgttgcagaatttgtctgtacgacatcattgatctgctcaattccctcattaatctgcttaatttctgtcgtctgtgtctccaacgtctctgcaatatttgtaacttcagtcgtaattaatttggaattctcagcaacctcttctaattgtgccgcagtctgtcccgcaatcaccattcccttttccacagctttcacagaggtttcaatcagattcgcagattcctttgccgcctgcgcactctgatctgccaatacgtttacctgatttgccacaactgcaaatccctttccagcctctcccgctcttgcagcctcaatggaagcattcagtgccagcagatttgtctgggatgcaatttcgttgattgttgtgataatcttatcaatctcttttgatgcctcgctgatctcatgcatggaatcaaccatttcatgcatcttgccattactttctgaaatggcatttcccagttcatccacttttacactgatttcttttgcagaatgtgaatttttttccacctgttctgaaacacctgtaacagttgctgtaagctcctctactaccgctgcctggtttgtagctccatctgcaagatcattggagcttgatgctacctgctctgctgcgccggagacttcattggaaacattctggattcctttgatcgtacctgccatacttgcctgaaatgccataaacgaatttaaaatactgacaaaatcacctctccactccgcctcaggatgaacatcaaaatttccttctaaaaagagcttcatggagcggtcaatatcatctacataggttcccagtatacgaattgatttccgcatactgtgcgccagtcttccgatctcatcatcggaatgatattccagcgtactatgcagatttccttctgttaattccgttgcaacgtcctcaatcgcatgtaatggctccagaattgtttcaagtactctcttacttgttttccgcgtcaaagtaaatgcacgaatcaggcagacaataatcactacaaatcctgcaaccgtacagactactatatttctgactgtctcgctgcttgcctcatctgtcagttcatctaattttatcgcaatttctactactttatttaaagccggggtacaatcattaagaattgcatctgtggcattctcatcgtttccgttttttatttcttccataatggaataaccaatttctccccagtcagaaagagccgatgaatattcctcgtaattttcatcggaaaggacttccgttttctttaaaatctgcagttcagaatcaacttctgaaagcagtctttttactgtttgttcatagttatcgtaagaggatgtatcctcatttaatgccatctctctgatatttcttgctgcagcattaacgttaatcctgcagatttttactgcctggtctgctgcattaacatcctcaacataatgcatcatattggcaaacaatacccctataattacaacagaaagcagaccagagatcaacatcattgtaatgacttttctatagccatagtctatcctttcctttaaatgcatgttttccaatttcttcttcttcatactctcttgtgatatcatgggattcttattcctttcgcttatttttagtatatccttagtactaatacactaatatatcaacttctttttaaaagtcaatacacgtcatttattttattttatttttattttacatctgaccgtttcggcaatctgtccaaaaactcacatcggattctcaagatattccgcgagcacctggtacagtctctgcggctccaccggctttgcaagatagtcgttcattccggcttccttacaggcatccatatcctcgcgcgcgtccttcgcgctcattgcgataatcggaatcatctgcgcatccttgtgcggcacccgtctgatctgccttgccgcctcaaaaccgtccatcttcggcatcacaatatccatcaggaccgcatcgaaataatgctcttccctctccataaaaagctccagcgcctgccgtccatcttccgcacagacgacttccacgccccggcgctccaaaagcttccgcgtaatctcaacattgagcggatgatcctccgcgagaagcacccgcttccccccgagcgcggcaaacgcctgtctggaacccccgcctctcgccacttccttctgcggctgaatatccacgagcggaagatccagatgcaccttcaccttcgtgccctcgccgatcgcactcgtgactgcaatacttccgccaagctgctgcacaatattctgtgtaattgccagccccagtccgctgccgtgccgccgttccgcctcatcccgtctttcccgcgtaaacggctcaaacagcagttcctgaaactccctgctcatgccgattccggtgtccgcgacaacataatccgcagaaaaagtaccgctgtgaaccgcataattgcatacccgaaaagagatctctcccccttccggagtgaacttgaccgcgttccccagcagattaaaaaagagctgctccagccggatcggatccaccatgacattcagactgttctcgccgccggacatgtgaaatgtgatcccctttttggcacactccggctctgtcatatcccggatcgcctccataaaatcctcgagcgcatacggcttcggatgcagccggaatctccccagttcaatcatggaaacatccacgagatcattcaaaagccccatcagaaaccggctcgccgtatcaatttttccaagacattccaccatcttctccgggtgatccgactcttcaagtccgaccgccgtcattcccatgatcacgttcatcggcgtcttgatgtcattgctgatgcgggagagaaaatccgtccttgcatccgcgacatgctgcaacgcctcatccctctcacgctccgccttccggatcaaaacgatgctgaccgccagtatcgctccgagaagcagcaggaaaatcagcagcaggattccgctttcccccatggtctttttcctccaacaagtatcattccgacaagcagcactaccgccgtcgccacctgatccggtgtcccaaaaacaatgtcacgcacaaaactccacgccgcgtgaaacgctccgattccccatatatttccgcgccggatcagataaagcgccgcgaaaataccgaacagcataccgtttaaaaatgcaagcggcgcctccacggctcccgccgcgtacggaagcgcaccgatcaccgcactgataagcaccgccaccgtcatcgaatagcgccgcgcgatcgttaccatcaggtaactgcggtacaaaagctcctccgccatcccctggatcagatatcccaggagaaacagcaccagcatccccggcgccgttccggtaaacagcttcgcttttcccgccgccaccgcgataccccccgtgactaccgcaaataccaccccaagtcccagtccaatggcatattcccgcagcgcgtgctccttcacaaaaccgatcatctcaaagctgcgcttctggaacttcctgcagaataagacgaccaccagaagcatggcaattccggaaaaaagctttaacaccgcgtaggcatccgaacccgcaatctgcaccgacacctccgacagctgttccatatccccggaggcagccgcatcctgatatgccgtgttcgtattcagcagcacaagctctcccggcagcagaatcagcatctctccaaatgccgcaatgatgtacaccgtcacaaacaccagcaattccaccagccagtgctgccccttctgtacctttttcgactgctcaacgagcttcggacaatctatgctctctttcatctcaatctcccatcctgcgtgtgggcttctgtctgcccgctgcgacatttcattttacggaaaactgcctgtttccgccgtttttctgcacttatcataacataaaaaatggagcgatgcaaaaatttcctgcaccgctccacacgcattttccggctcatttcttccgccggctgacgcttattccggctcacttcttccgccggctgacttccatcccgatccggttactaacgccggattcctatcccagctcgattaccgccacttcacagcttccgagtgtcagcgcgttcgctttttcacatgccgtctccaccgcgctctctgctctcagattcgacagcagtacctgcctgcacggataggcaagcgtcagggaaaccgcatccgttccaaagtttgctgcaaccagtatgcgctgcccactctccccggacacacggtaatacgcaaatacatccgccatttcctggtaagccggctcgaagataccgtaggtgaatgtttcccggtaggcgtccgccttgcgcagatgcaccagtctccggtaataggcaagcaccgaatccgtccgcgcctcctgctccctgacattgatctgccggtaattcggattcattgccagccacggcgttccgtccgtaaatccggcattctcatcatccgtccactgcatcggcgttctggcattgtccctgctgttctcgtagcagcagcgcagtgcctcctccctgctgcagcccgcgtcaatggcaacctgatactgatccttcgtgctgatgtcgtcatactccgaaatgtcgttccggatgcaatttgtcatgccgatctcctgtccctgatagataaacgggatgccgcggagcagaatggatgtggttcccagcatctttttcccggcttcatttcttgcatgctccggcagatagcggctcgctccgcgcggctcgtcgtgattctcaataatgttcgccgcgaatcccgccttctgcaattttaactgggatgcaaacagcgtatcgcgccattttttgaattcgattggtttgctgtcataccagccgtgttctccgtaggtcagctcatgtgcggaaaaatcaaacatggtggaaaaatgcccgtcatccccgatgaactccggcagttcgtcctccttcatgttaaaaacttccgccacggtaaatgcatcccatttttcaaaggttgcatgttttaagtcctctaaaagcgcgccgactccctgcacttcctcaaccatcttcacacaggaggcaagtccgtcgtctccatccggcgggaatgacggaaatgccgtgtcttttttgatgttgatgattgcatcgatgcggaatccggcaagtcccttcgccagccaccagttcaccatatcgtagatcttctgacgaaggacaggattttcccagtttaaatccggctgctcttttgcgaacatgtgcaggtaatatttgtctgttcccggcaccggctcccacgcatttccgccaaaatacgagcggtaattgctcggctccctgccgtcttttcccttcacaaagtagaagtaatccgcatattccccatccggatctgccagcgcctttttgaaccattcatgctggtcggaacagtgattcaccaccagatccatcacaatgtacatgcctctcttttttgcctcggcaagcagctcgtcaaactcctccatcgttccgaattcctgcgcgatcgcgtagtagtcggaaatgtcatacccctgatccacaaagggagatttataaatcggagagagccagatgatgtcaatgccaagctctttcaaatagtccagcttcgagataattccccgcagatccccgattccgtccccgttcgtatccagaaagctcttcggataaatctgatatgccactttatcgtgccaccattttttcttcattgcacattctcctttttcccaatacggtttttcttttcctttttgtatgatactgttattataataagagaaatccgtaatatcttgcactatattttcttttttattgcacaatactgctatttaatatcaggggaacgcacatgaataggacatccattccggcgccggagcaaaaggaacacgcccggcacggtgaacagctttttccactgcaaaaatatatcaccacgctggacgatctgcacccgtccgtcagcgcacactggcacgaggaagcggaatttacgcgcattctctccgggagcggcacctatcagatccagctgcagcactatgacgttgccgcgggcgatctcctcttcatccctccggcgctactgcacgcaatcaccgtgacgcccagagagaagctttgcaccgagacttatgtttttcacatgcattttctcggcgccagcaccgcggacatctgctccgtgcagtatctgacgccgcttgcgacagcaaagctgattccgccgtttttctttgatacccgtcatccgctgcacgctgccttagatgacctgttcaacgatatggatgccctgcacgacgccgccacgccgggctatgagctgctgctgaaggctgattttctgcgcctgattgcgctgcttctcccctgctgcagcgcagcggatgaggacacacggctccacatggaatataccgccaaattaaaaacagttctggagtatattgatgcccattatgcggaggagctttccatctccgctctggcttccctgtgctatttcagtgagtatcatttcatgcgttttttcaagcgcttcatgggtacctcctgcttaaattacatcaagaacctgcgtctggagaaggctgccgagctgctcgggcaggacaggcttaccccgctggacgtctccctgtccgccggcttccacaacctgtcctacttctaccgggaattccggaaaaaatacggcgtgaccccgggggatttccgcggagccggtgcccgggagaaataggctttataataggaaatatcattccggagcgaagcagcgggacggagtctttgaaacaaaatgcaagagtttcttccctgccgctttcggcaattcattccgtgtctttgccacgcttgaacaatccgcgaatgtgtccgacaaacccgcagacaatgagcggacttcctagcagcgctaagcacacctcttcacagacatgataaaaccgcgcgagccgaaactcgttgctttctgctattaaaaacaaggcagaaagcagctcaaacatcggtctcgcgcggttatgttttgctcatcggtgtgcaaagtgctgcacgtaagtcctaaaattgtctgcggcttgcggacacattcgcggagtgctccaagcctggaaagacgcggatcatcgcagttgtcgaaagcggctgggttagaaagtccgtattttgtgatcagactccgccccgctgcttcgctccggaatgtgattgtctgttataaatccccgtaaagatcacttctccccggctggctccgtgaaaaccgcccggggcatgccctattttccggtcagcggctaccgcaggcgctcttcgcggtactccttcggcgacatgccatattcccggcggaacgcgcggtaaaagctggaatagtcccggaacccgaaccgctcatacacctggctgatgttctcaccgcctaaaatcgcctcccgggacgcctgcatccttttctttaaaatatactggtgaaccgagattcccgcctgctccttaaagacgtgcgccacataatagcggctcacgaaaaaggctcctgccagtttttccaacgacagttcctcctccagatgctcctctatataatagatcagattctgatagagatcctgctcctttaccttggcgggattttcttcctcgtacaccatccggttcaagtgcaggatcagatcgttgaccagcagcggtatccgcgcctccctcccaaaacgctccatctgcatctcctcaatcagctgaaagattttaaactgcgtggcgttaaatgtaattacatcactgtgaaacacatttttcccggacacttccgcgcgctgcatcaggtagccgtatgccggagaaagttccatcagccggctggcatattcccggctgacccagaacacgaaccggcggtatgcctgcgcatggttgtgcacaacggcacggtgcctgcggtgcggaggaattaccaccatatccccatagcggagcgggtatctctgcccctcaatctcaatcgagacgtccccctccataaaaaaatagaactcataataatcgtgtgtgtgcgtatccacttttgacgtgtaatgttcattataataatatagttcaaaatcgcgggacagcatgtactgtctggtgctgaatctggtctgtaaatttttctgcatgcgctatttcctcttcgggcactcctttcatgccgccattgatccgttgctttcctttttcgtcttatattttttcaaactcttccctgattatagcggaagatagcaacttttgcaatgtatgcaacaagtctttcaatttgcttttggagcggattttatataatgaaatcatccaatatgacacttccttaacggagcagaaaagaacggaggttacacactatggaaatgactttaagatggtacggttccaaatttgacaccgtcaccttagagcagatcagacagattccgggcgtgaccggagtcatcaccaccctctacgataccgcaccgggtgaggtctggagcagagagcgcatcgccgcattaaaggcggaagttgctgccgcaggacttcatatttccggtatcgagagcgtcaacgtccacgacgccatcaaaaccggcgcaccggaccgtgatctctacatcgatcactacattgagacactggaaaatctcggaaaagaagatatccatctcgtatgctataacttcatgcctgttttcgactggacccgcacggaactcgccagaaagcgtccggacggttctactgtcctcgcttacacccaggaggctgtggatgccctcgatccggagaaaatgtttgagtccatcgccggggataccaacggcagcatcatgccgggctgggagccggagcgcatggcgcacatcaaagagctttttgccatgtacaaggacattgacgatgaaaaattgtttgccaacctgaagtattttctggagcgcatcatgccggtgtgcgacaagtatgacatcaacatggcaatccatccggacgatcctgcctggagcgtatttggtcttccgcgcatcatcatcaacaagaaaaacattctccgcatgatgagcatggtcgacaatccgcacaacggtgtaactttctgctccggttcctacggaaccaacctggagaacgatctgccggatatgatccgttccttaaagggacgtatccattttgcccatgtgcgcaatctgaaattcaacagcccgacagactttgaggaagccgcacatctctcttcagacggcacttttgatatgtatgaaatcatgcgtgccctctacgagatcggttttgacggtccgatccgtccggaccacggacgtatgatctggggcgaagtcgctatgccgggttacggcctttatgaccgcgcacttggcgccacctacctgaacggactttgggaagcaattgagaaaggagctgcacgctatgaagctaaataacaaaggattagaaaataagaacgcatgggaagctgccggttacgcacttccgcagtatgacagagaggcggttgccgccagaacaaagcagaatccgttctggattcatttcggagccggcaacattttccgtgccttccaggcaaatgtggtacaggatcttttaaacaagggagatcttgaccgcggtcttgtcgttgccgagggttacgattatgaaattatcgagaaaatgaatcatccgcatgacgactacagcattcttgtcactttaaaggcaaacggcaccgttgagaaaaccgttgtcggcagtgtgatggagtctctggcactcgattccgaggacgatgcacagttctcccgcctgaaggagattttctccgcggactccctgcagatggcaacttttaccatcacagaaaagggttacaacctctacggttctgacggcagcttcatgccggcagttgccgcagatatggcagcaggtccgcaaaagccggccagctatatcggaaaagtcgcatctcttctgtatgcacgtttccttgcaggtgagaagccgatcgccatggtaagcatggataactgctcccacaacggagataagctcgcggcagccatcacagcattcgcagagggctgggtaaagaacggtcttgccgatgaggcatttgaggcttatgtgaagacttccggcaaggtatccttcccgtggacgatgatcgataagatcaccccgcgcccggacgcttccatcgaggagattttaaagaaggacggtgtcgaggaactggatccggttgtcaccagcaaaaacacctatgtggcgccgtttgtcaacgcagaggaatgccagtatctcgtcatcgaagacaacttcccgaacggtcgtccggctctggaaaagggcggtctgatctttaccacacgggagaccgtcgacaaagtcgagaaaatgaaggtctgcacctgcttaaacccgcttcacaccgcacttgctgtttacggctgcctgctcggctacaacttaatctccgaggagatgaagaatccttctttaaagaagcttgttgaagtgatcggatataaagagggacttccggttgttatcaatccgggcattctcgatccgaaagagttcatcgataccgtattaaatgtccgcattccgaatccgtttatgccggacacaccgcagcgtattgcaaccgatacctcccagaagctggccatccgtttcggcgagaccatcaaagcctatgcggcagctccttctttgaacgttgccgacttaaagctgatcccgcttgtatttgccggatggctgcgctacctgatgggtgttgacgacaacggtaacgcattcaccccaagcccggacccgatgcttgcagaagcgtcctcctatgttgccgatgtaaaactcggcgaggctttcgatgcaaagaaaacgcttgcaccgatcctctccaacgcaaagatctggggcgttgacctgtgcgcactcggcatggatacgctggtatgcgattactttaccgagcttaccgcaggcacaggcgctgttgcggcaacccttgcaaaatataccgcttaatccagagacagaacaatcctttttcctgttacttatcacgtcaagaggggctgcccgcttcatgcggcagccccctcttctatgtacgatcgctataccggctgctgaccggaaaacatcgaaaaatactcctgtgctctcccgctatatttttgtttttacaaactgatatatcttttccgcactgtgtttttccattccctggcactgtgctctctgcatcgcgtttctcttcccgggattatgaagcagctgcattccttttctgaccaggccatattccgtgtatgcggtcacgctcattccctttttgacaaaaaagctccgattctttgtctcacatcccggtatcggctttgtgtggacaatgggaatctccgtcactgcggcctccgtggaggtgagtccgccgggttttgtgtaaatgatgtcacacgcatgcagataaaccggcatgttgctgacgcttcccaggatcgtcatcctcgcatctctgccgaagcgtgcctgcatccgctgctctagtttctgattgctgccgcagatcagaatgaggtgctcctccccttgtatgcgcctcagcaacgccggaatcagccggtcgatcgatcccgctcccatgctgccacctgccacaaggatataccgctgtttttcttcgagtcccagactttttttcgccgcctgctgcacctttttgcgcacaatgctgtgcgcgtgtgtatccgccgcagcactttcttccggcgtaccaccccacggctcactgcatgccgccgccaccggaatgcccgtcaccaccagcttttcttccggaatcccgcgcttcacaatctccgggatcagactctcgtgcggaatcatataatagtcgcagtccgtctcttcccagaacgggatacaggtataatccgtcatcaccgccaccgtgagcggaagcttcattccctttcgcttcatataggtaatggtttccgccggatacagatgcggcatgacaatcacgtccgccggatgtttcttcagatacgccgccaggtagactgccatcttcccattgacataatagaccggcgaacgacggagaagccggctgacaagcatgccgatcttatacaaaagtccgaacagacccggggcaatctttaccgtctccacatagacgttaccgaccgtcctcgagaccttctctcctgcaagcttaagataatccagcaccaccgcctcgtccccgtgcgcacggaaagtctccgcaaccgcgcgtgccgccgcgttgtggccaccgcctgtattacatgataagatcagtacattcatttttttcctcccccgggcatccgaatgtgtgccggtagataaccgtttcggcaatcagcaggcctccgatcagaaccggccgctcctccaccgcaagacaggttcccgctgcaaagcacagatacgtcacaatactccgtctcacatggcttttgatcttaagcaaaagtgaaaacagcagataaaacagcaccagcatcgctaacggctgccagattcccgccggcaccagtcccagcagaaccccgaaggataccgcgatcgccttgccgccgcgcccgcggtgataaatggaataggcgtgtcccagcacaggcgccgccattactgccgcaaaccacagggattgcagaccggcggtccgctcgcacagccacaccggtaaaaatcccttcaaaagttccagcagcagcacacaggttccacagactgcgccgccgtaccggaatgcattgtaggttccgggatttccgtcctccgacatctcccggatatcgatatggcgggtcagcttcggaagcacataagcaaataaaatgcttcccagaagatagccgccgatcacaaatcccagataactactcataaccgctgctcctctcgctctcgttttctaacactgatatgtaatgtaacatattttctttcataagaaaagacagggcggcagaaactctttctgtcaccctgtccttttcgtttatttccattacactcccctgtaataaaaaagaatcttgcttgcgagattctccgcgcgcgagcggttcgcaaagcgatattttccttaccgcgagctgcgcatcctcgcggagcgttttttatttcataggaaagttccactttcacacatgaatgtatcacggtatttcctatgaaataaaaacaaaaccggatataggaaatgccctcgcagacgtttttgtcactcacgcagcaggtacgcatccctctctgctcccgtagataccagataaatcggatgatccacgagtttctccagtgtacacacatattttctggcattttccggcagatccttccagcttctgcagccggaaatatcgcattcccagcccggcagttcctcgatcaccggttctgcctcctcgagtctgctgtccgtcgggaaagaatcaagcaacacaccgtgcagacggtatcccgtaattaccggaattttatcaaatgctccgagcacatccagtttggtcagtgcaatatcctgcgccttctggcaccggatgccgtaacggcttgcaacagcgtcaaacggtccgacacggcgcggtctgcctgttgctgcgccgaactctccgccgctctcccgcaatttttcattccaggcttcgcccatcgccgtctccgctacaaacggtccctcgcctacgcatgtggaatatgctttcatgacgcctaccacgttgtcgagcgcgcagcccggaataccggcaccgatcggggcatagcttgcaattgtattggagctggatgtaaacggataaatgccataatcaatatcgcggagcgctccaagctgcgcctcaaacagaatatttttcccttgaccggcagcagcaccgagcaatgttcccacgtcgcagatataatctttgaaaaattctgcctggcttctgcaccactccataatctcatcataggagagcggttcctgattgtatacattctccagcaccagattcttgctgtcgatgataacttttaaacgatgctgtacggacggcgcatccagttccagcagatcgcccatccgaagcgtctttttcatatatttatctccgtaggcgtaggcgatgcctctccgggtcgatccgaatgcggaacccgtcttggaaagccgctcctcctcaagcacatcctgtctcacatggaacggcatgcagatggtcgccttatctgaaatcttaaggttcgacgcatccacttttactttcatatactgcatcattgcaatctcatggcgcagatgatccggatcgatcaccataccgtttcccagcacacagactgccgtcggatgcaggataccggacggaagcagattcagcacaaattttccctgatccgtcaccaccgtatgcccggcgttattgcctccctgataacggacaacatagtccgccttttctgtgagaagatccacgattcttccctttccttcatcgccccagttaattcccgtcactgatgttaacataataattgcctctctttctaattgcggatgtcctccagcttcttggacactcttgtctttctttttcttccggtatagtctgcgcggatgttctgcacaatccggttaaaatcactgtccgccaccgccacatcacagcaggtctccgagtctttgtctccatagacaatactgtgatgcacatgcagcatcttcataagccggtcaagcatgttccgcgggcttgcctcaatcgacagaatcttgagaagactcttctccccgaatacgtgatcctccaacaggaatttcagcttcccggcgaatcccatctcctcaagctgcttctccagcataatcaaccggttgtgcgtgtccagaacactgaaatacaaaatatgatcttcatcgtgcggtgcacgtttcatatagttgcggtacggcgaagtccggagtttctttaagtatcctttctggtcctcgtccaccagatcgttatagtaaatcacccacacgtcatccacgatgacattggtgaaaaatgcgcggttctgctccgtcaaaagctgccggatacggattcccatatcgtgctccatcaggcatgcatgcagatacctgttctgataaatatcatacagaaccgctccgtcaagggcgatcaccggcaggcgcagctttaagtgctcgacctccgcaatcaaagacgccggtgtctgtctggtaatcatggtaaaaagtgcgccctcgtcaatcatatgatttaatgctgtcttgttaaattcgctgatctgccggtgcgcactgcgcagctcatcatccagctccgccacgaacagcacatcgttgcgcttcttcccgtgtgtgtgaaaactgccaaccaggctgccgattcccacgccgaggaaagtatccaccaccctgtaaaacaggaattcatacggcgatactccatcatgtgtgatgaccgcaacgcttaaatacgccacgcacgccatgaacgcaatgtactgtttgccgagcagcaccgtcagataaatggtaatgcagatcattaccgcgtttaaaagatcccaccacagttcgcctccgggcagacccttgaccggcatttccagaaacatcgccaccgcaccggtgaccgcgccgatcaatgttccgatcgcacggttgaatgccgtgtcctttgtgtttgcaatatccggctggatacagatgatcgtcgtgatcagaacgtagaacggcgaccgctttgcccctaccgcagtaaaaatcaacaatatcaggaaagccgctatcgatgtttttataatcctcatgccaatgcgcggcatactttttttcatgcttctcatcccttttcagacacttctggcataacgttccatctcttcccggaaccccagcgcaatcccgtttgcctgctcaatgttgcgctccatggcatcgccaaaatgacgcagcggaaggaaaattcccagttcctcgcttccggtctcctgcccgtttacctgcattttcccgtaatacataaaggcacgcggcagcacatcttcaagccgcatcagcgcgtcccatacatggacatacacctgcgcatccgtcagatgctcctgcaaatgttccggcatggcatagagcagcaggattcccagatgtcgcccgatctccacgctctccaccgacagatcctcctcgccgtagcggtgctcctcgcggaaaccgtacgccagatattcccgcatctgtgggatcggctccctgtgctgatagattctgctgaacttctggtaaaccttgtccgggacgttcaccgggagcttctctcttaagattccctggtcatcggtcaaaagaatcgggtttgtcttgcccttgtcgtcaaaccggatcgggatcagaaaagagttgcgcagcagatcaaacatgctgtttccgcagatcgccatcagaaatgccgacagatccttgttctggtatgcctgaaacagcgccctcgtaaaagtctgtggcgataccgccggcatctgcgcatccatatcctccgattccggaaaatgctcataaaacgtatccttcagccgctcacacgcatccggattttccagaatcttctcgaacaactgctccgctttttcttcccttggaaaaatagttgccattacactctcccctttctgtctgttctcacctgttccatacacgcagcttttccaggaacattaacagcacgctcaccatcaaaagtccgcctgatacccagatcacatgtactccgtaacgaaccgataagttgccgcctgccccagcgcccagcgcgaaaaacaagatgatgccaaaataataaagagcctgctttaaaaactcgggacggcgctccctgaaatacatggaaagcgatgccgtaccactccgcagattgccgatgcacatcgtgctggcgtaggaatagccgtccaccttccggaatgcctgcacctgcatcgcacaggagaacgacaccaggatggtcgccgtcatgttgagggtctgcggaaggaatccgacaatcagaaggattgcaatttccagaagcagaattccctgccgccagtgcagccgcctggcaaagcggaactgcgcctgtatccgctccgccgccagcacgccaaacgcgaatgccagaagcggcagcagatacttcagcccgtccttccactctcccatcataaaatgctggctcatcaacaccacattgcccgtctgcgcgttggagaacaccttgtctctggtaaagtaggtgtatgcatcctgaaagcctccggacattgcaaggaaaatactgttgataaacgcttccgacatctgcttttccggaagtacctgtgtcatccagcctgtgaactttccctttttcacctgtatcactccaaactctcttgctttcttgatccttctgtattatactgaccgaaaatagatatgtaaaaagtatattttatatattggatatatcaatatcatatatcaaggagtgcaaaaggaggcacggatcatgacgctggattactaccgcattttttactatgttgcacaatatcaaagcttttccaaagctgctgagattcttgggaacaaccagccgaatctctcccgctgcatgaatctgctcgagagcgagctcggctgcaagctgcttgtgcgcaccaaccgcggtgtcagcctgacgccggagggggaacgcctcttctcccatgtcgctatcgccaacgaacagctgatgctcggggaacaggaaatcttaaaagacaaaagtctcgaaagcggtcttgtgaccatcggcgcgagcgagacggctctgcgcctgtttcttttgaacaaactggagcttttccaccacaattatccacatgtgcgcctgcagatttccaaccattccacaccgcaggccatccgtgccctgtcgcacggcaccgtcgatttttccgtggtgacgaccccgatcgacatcaaaaaacctcttcacaagacgtcgcttttatcctttcgcgaaatcctgatcggaggttcttcctatgccgctattgcctcccgcatgcagagtctgcacgacctgtcggaggttccttttatctctctcggagccggaaccggcacgagagaattgtattcccagtattttctaagtcatcatcttgtattttcaccggacatggaagcctccacgaccgatcagattctgcccatggtcgcgcacaatctcggcatcggcttctatccggaagcactcgcctccgaaccgattgcgcgcggggaagtgcttcccatccgtctggtcgagccgatcccggaacgtgagatctgcctcatccgggacacaagccgcccgaagagcatcgctgcccagaagctgatggaacatctgcagagcgatacctgaaacgacaccgctcaaatgcttttttctgcaagaagcgcctgtatttcctccggttccggcatcacgcgcagcgctccgcgtcgtgtcgtgacaatcgatgccgccgcatttgcaaaacgcagcatctcttccaactccgtcgtgccaaatcccgccacgccgtgttccagaatatagtgcaggcagcatgcaccgaacgtgtctcccgctccggtcgtctcgatcgtgcccgcctgtataaatgcaggttgttcggctctgcggctgctgcagtatgcccggcttcccccgcttcccatcgacaacagaatcagaggaatgtagtattcccgccaaagcatgtccactcgcggtcgaaatcctcctcgccggtaaatcaccagatctcattgtccgatattttcagcacatcgcacacttccatcccgtaagcagtctgtctcttcgtctcttccaatgaccgccagagcggttcccttatgttcggatcaaaggagagcatcgccccgtttgcctttgcggtctcaatggcatgtcctgtggcgcttcgcaccggctcatccgtcatcgagagcgtgccaaaatgaaatatgcgggtgtcctttaagatctgctcctgcagttcctctgtacgcagcatcatatccgcgcccggattccggtaaaaagaaaaaacgcggtcttatgtccaaacttctgcagcattgccagcacattgcagggtgctccgcccggattcgcctcatacatgagattcccctgtgcactgctgccgttttccgtaaaatcaatcagcacttccccccgcgtacgtctgcgccgcatacggcagcttcctgagatatgcctcgtttacagtaattacctttaagatacaatcatctgcttcttcaaactgtctcctgccttccagtttttcatattccataaaataatttttatcatcctttatatccgaaacctgacagcaatagtcaattgccagctgctgatataattttcttttatatcatccatatccatcacctcacactacgataagctgatcatccacttacgcctcttaaaaataacaagcgctaccaccagcctgaatatttcttcggtggtaagcagtgtatacacaccaactatgtcccacttaaatgcatatgctgcaagcagacacagcgggattccgatgcaccatgtgccaacaatatcaatcatcataatcattttggtattgccgccgcttcttatgataccgcctccgagtatcatattttcaaccttgaccggtgcatacagggcaaatacaataagcaatatctttccaagttcttttacactgtcatctacacgatacagcccggtatatactccagccagaagaatgagcaatatcgatactgctgccgcaccaattaagcctgcatacattattttcttcgattctgtataagcctcatcatactctttcctgccaagcctcttgccaaccattacaccggcagccgccgacaatccgctaagcgctcctacaataagcccctgtatcggacaggtaagtgtgtatgccgccagatttgccattccaagatgcccatagacggcagactccacattttgtccgaggctccacaaaaattcactgaccagaatcggcataatcatgatcagataatccttgatagtaattttactgaaacgcaatgaccataccggtttatcttcatcctttctgatacataaggcaaatccaaccgcaataaataccagattaaataactgcgaaatcagtgttgcgatcgcagctccctttattcccatacatggcaatccgaattttccaaatatcagcagataattaagacctgtgtttacagcgactgccccaaagctcgcccaaaaaggtattgtggcatgctccctgcagcgcagccacgaagataaaatattgccggccgccattggaatataggagaacgctactatcctgaaatagaccgcaccggtatttacaatactcacatccctcgtgtacagcccaagaatctgcgagggaaaaactcctgctgcaaacaaaaacagcgcagctattaccattccgctaataaggctcacatcaaaactgcaccatgcctcttttgtatcttccgcaccaataaactgtgcgatcagtatccccgcaaccgtactcactgcaccaatcactacagaaaaaatcagcgaaaagtttccacatagtccaactgccgatatgttagtctacactaactgtcctatcataatctggtctacaattgaaaaagatgcctgcagcatactttgcaaggtgacaggaattgctattttacacaatgttttcataaatttcgacattataattcccccgtactttctctcttaattaactcaaccggcaacacaatttttgtctcacattctgctccatcgcgcattgcctcaagacacttaattgcagtttctgccctaagggacgcctcctgatgaattgttgttagagaaggatggctttccctgcttgccatgttgtcatcaaatccgattatctggatatcccttggaatccgaatgttctttccctgcaaaaacctcataaactcaagtgcatagaaatctgataccgcaaaaacagcggtaacatttttctctaacagcgcctgatatttatcctcataaaaacgcattctctccttttctgtccttggtattttccatcttaatgtttctcccggtccaaaggcttcgctaaaaccttcgatgcgctctttatccatgcagataaaattgtccgctatgcacaacgcttttttatgtccaagctccctaaaatatcttcctgcctgataaccaccgtcataatgattgatgaccagattgaccaccttggaacatttttcaaaataaccatcatacactacaaacgatatccgcatctgatttctgagtttctcataatccgcttcacaaaaacccatcagaatcagcccatccatattccacatagatgcaaacaccggaatctcactgatgtcagatgtcgtttttatcatcagaaaatatcctttttcatttaccccatgggagagagcatttattgaagccataacaaatccatcctctaaaaccctgccctcatacttttcattatcattcaccaccactccgatgattcttgaattattcctggcaagcagaatagctgccatattcgggatatatcccgacctctccagctcctgctggacgcgttttaccgtctcatccgaaatcttttctgtttttccgtgaatcacctttgagacagttgcagtactaagacctaatgaatctgcaacatccgcaatccgaactctgtcctgtgccatatgtattccttcttttcctatattctgattatatggtacaacagaaatatgtgtgttacaaaggttaagtgcataacccatgacaaaaattgcattcctgcctcttgcatacggttatgaagtatgtccacctcttgcacggtggcgagccgatgaactttctgtaatagaaaaacaccctacattgctgcaaggtgtcgatgttgtatgcatcttttatctctggtgcgtatttcataatcatgtctgcaagaaagccacagcagcatccaaaatccttgttcattgccaagcctcccttaaatgcaagaatttcttactattttacaagtgaagtttggactatacggtctttggtcagcaatgcctgatgccgaatttctgacactttttatctccatacctcttttgaaatggaaaccatctgcattttctcaaaaataaaatacgatacaacatcatatcgtaaaaaagtaaagcatatgccatgttgttttctcctatcttcccaccagctttaagaatttcttatcattcatctgctcattcgtaacatactccccatcacaaaatagtgcataagtcgtaatcggtgttggtacattctgagcatccttcctactttcgatcttcacagccttgaatggaatgccattcttctgagcggtttcttccaggattggtacatactttgcattgaaaggacattggtttgtataataaagaacatagccacgttcatttatatgagggtgttttgcacattccttgaacaccggtggctcagttttctcttcaaatggcagataccataactggattccattatcagcctcatcacaaacttcaaatcctttatattttagaaacttcggatcagccagaaatggctttttccttgctgccgcaagaatacataggccttccttccccttttctctgctgtcctcaatacacctggaaagtaagtcacttgaatatccatgacctttgaaagaaccggacacccacaaacaattaatatacatataaccaggtgcctcgattggattccatgcacactccgcaggtatgtactcaataaagcacttgccgcgttctacgctcttaagaaacacaagaccttcatcaaatctatccgcaagccatgccttctttgatgatacctgaatatctttattgtcggaaatggcacagcaaatatgctccttttcaagattttctttcgtaactctaatatattccatacctttaagccctccttatcggatgcctgaccacagtcttcaatttctcaggtgccactctccgcgcatcactcagataaatctcgtggtgcatcctctgatccgttatatcaagtgtatatccctgttcttccataaatctgtgcattgcatctaccgtagcaggctcatcgtcatacgctccgatatgcatacactgtacacataagccctcctcataggaaaaaaactcaaccttagaaaaatcctgttttttctttgccgtagctttcctgacagcccagtcgaaattctccctggtaacaaaatctggcaagcgaataacagaaatccacttaaaatcttccttacgagcataatcaattccggatacgccgtctcgcctgccggctcggtcggttcgcagcatggcgtcccccggacgccgctcaccctgccaccagaatccctctaatggcggcacgacataatcgaaatatccatcaatctgatgatcttcctttttgctcattttaatcgtaaatgcaattccatacagaagtccgatagcctgcttgtattctccgtctgcatcatttggattgccgcttccccttaccgctatatagttcattttcggaacagttacgatagacggtgtgcctttcggcatataaaattctttatattcttttttataatcaaatgtcattttcctaatcctccatagatttttaatgtttcttccgcattcctgcggataatgtcccgtgcttcttttggttcaagcacctctacttttgctccaaatgtcataagccatgtcacaaggttttccatatccgtatagtctgctgaaaagagcagccttccatcgtctgtttctgtaaagcagttcggtccaaattcttcaaccagccgccacttcatattcggtgtgaaaagagcttttacctttatcccacccggaaatatcttctcatttgacaaatccggcattggtacatctctgcacagaaatccacggtctgtttcaacaacacaatccatacggttcagtttgaacagcctgtaatctttacgttctaaacaccacccccatacataccagctcgaccactggaaaaccagataatatggttctacccttcggttgctctctccggacggagcataatacttaaatcgtatgatgcgcctgttttctattgcactctgtattacctcgatctttggagcaagggaacccttataccatgaagataagtcaatcagcatagagtctcttccactgatgaactctgatgatccggtctggattttctccatcagctgactgtagtatctgcttccgctcacactgtcaagactccgcaaacctgcaagaatcatctgcatatctttggatgtcagtatcgtcctatccatacgatatccgtccataatacttataccgccaccggttccctgtgccgtccttattggaatacctgctttgcaaaggtcttcaatatcccggtttattgtcctgcgggatacctcaaatttttctgccagttcaggagccgttgtcttttcttcctgcagtaagattgacaatatcccaataagcctatctatcttcataattccactctccatacatatcatatctaacacaacacgacaactatatgtcatgtttattatatccacaaaaaaattttctgtaaacaaaaagcctacgaacatcaggttttattcccaatgtccgaaggctctataacattagttaaattttctctttcttataagccgaatcatcctacgattcacttggaatcatctgaaaatatctcagtgcctctacgattgcctcctccacttcatctattttatcatattgggtatctaatcgtctctgtaaatctgaaattttttatcgtaatgaatatctgtaacatccagattagcttcatgaattctccaacagttgccgaagttgcaactataattgagttttcaggaaacagctttccctttactgctttttcagaaacatactgtatagcttttgaaagaatatttccattttctctaatatcttccattctaaaccatggaaccgacccattttcccaaaattctttatttcccttagatggagtatatccatttcttgtatgaaaaagctcagataattctttatactccatcccgtctgggcagaattcttcaatcaatttatcaagtttattcattttttgtcaccctcgtcagacatacactgttttttaaactgtcagttacacatttttgagccatctcgtgatccagatgctcaagtttgtcacgcatgtcaaatattccaagtttttcaaccatttttctacatttcgattcgtagtcatcaagatacaatggtattctatctactgtttcctgttcttttaacttagaaatatatacctgctgttgatacatagattttagtaaatccgcaaatgatgaaacaaattcgcctgctatccgagcagtctcgccatcaaatatcattgaaatttcaatggctaaattttttagcttctcatattttgtgagcagcattttttgttcctcttgatgtaacggttttgatacagcgagtgtcatttcttctaactcaatacagtttgttagccaagaaaaaaccaaatcgtttgtgtgataaaatgtgctttcatctttcaaatataacttatttgatacatataatttgtagattgtattaaactcaagaaaacacgaaagccgtctatcgaataattgctgtttgttgctcaaagcaatctgttgtttcgtttgaaatattgcaactagtgcaatgataatcgaaacgattgaaacagcaatattgactatttctgaatggctcattcctcaatctcctccccatcatcattctcacctgcatccggatgctgcatatagaaaatctctttctggcgttctatctcgactttcagttgttcttttgtcggaagacaggtcagatactttgacataaacaaatgatcgttatcgtgcaatacagaatatcttgcaatatcctcatccgtttctgaacagagcaaaatgccaatggtcggattatcccccggcttgcactttaaatcatcatacatccgcacatacatatcaatctgcccgacatcctgatgcgtaatcttacccattttcaaatcaatcagtacataacacttgagttcaatattataaaaaacaagatctatataatagtcttccgtttctgtgactatgtgttgctgacgggcaacaaacgcaaaacctcgtcccatctccatcagaaagtcacgtatatgagatatgattgccgtttcaagatcactttccaagtaactgtcttcattcttaaagcccaaaaactccgccatgattggatttttcagcaactcaaaactgtttttttgatagcctactgttttttgcttcatctctgcaatcacattttctttttggggagattgcaaaagacgattataatattgtgtggaaatattccggtcaagagttctgctgctccaaccttcttttgccgcttcgttcatataccaaatacgtgcattttcatctgacacacgcaaaagactgcgaaattgcgtccaattcaaattcggaacgcatgcgttccaaatctccttgtctggaaaatattggtagaattttctaaaatatcgcaaattacgttcagaatatccgtttccatattctttcgtcaattcatcagacaatgcaactaatagttttttcccatactcagcatgctcttttcccgcttgctcctgctcaacgattctttttcctacattccaataagtcagaaccattgccttactggcggcaccatacgcctcttgctgccctgcatttatgatattctttatatctgtaataacagactgatacaccatcagattattttccatatcatcccacctcgatttctgcgataatcttatcaatctcatcacgaagcacttgttcacgggcaacaatttctttaatttccgcattcagcttcacaatgtcaattttttctctggtatcctctgcctctacataagtggagaccgacagattataagcgttctcggatacttcctcataacttgccagatgggaaaaatgttcgatttcttcacgcttagcaaacacatccacaatacggtcgatattctcttgtgtcagcttattattgttggtcacctttacacactcgcttgtggcatcaataaacagcgtcttattgtccgtcttattcttcttcatcaccataatgcaggttgcgatagaagtgccgaagaacaggttactcggtaactgaatgatgcaatccacatagttattgtctaccagatatttacgaattttctgttctgcaccgccacgatacataattcccggaaaacatacaatggcagcagttccgttagacgcaagccatgacaagctgtgcatgataaatgccatatccgctttgctcttaggtgccagaactccagccggagcaaaacgaggatcattgatgagcagaggattttcgtctcccgcccacttgatagaatatggcggattagacacaatcagttcaaacggttcatcatcccagtgctgtggactgagcaatgtgtcttcacaggctatatcaaatttatcaaaacccacatcatgcaaaaacatattgatacgacacaggttataggttgtgatattaatctcctgtccataaaacccattacggatagcatcctttccaagaattttctcagccttcagaagcaatgaacctgaaccacaagccggatcatatactttgttgatttccgtttttcctacagttccaaggcgtgtgagcaattctgacacatctgccggagtaaagaactctccaccagattttccggcatttgatgcatacatggtcataaggtactcataagcatcaccaaaggcatcaatggaatgatctttcacatctcccagattcatttcacctacgccattcagcagtttcacaagtttttcattgcgctttgcaactgtagaccccagtttattgctgtttacatcatagtcatcgaacaatccggcaaagtcactctcagcctcactgccctttgctgattcctcgatatgacgaaacacacgctccagcgtctcattcagattttcatcatttgcggcgttggttcggacattacagaaaagttcgctcggaaggataaaaaatcctttttcctctaccaatccctctcttgcctcttccgcatcctcatccggcatttttgcataatcaaaatcagtattgcctgcatcaatctcaccgctgtttatgtaattgcacagattttcggaaatgtagcgatagaacatcgtgccaagaacataatttttgaagtcccaaccatcgactgctccacgcagttcatctgcaatcgcccatattgcacggtgcagttcgtcacgttcctgttcttttttggtatcaaccattctcttttcctccgttattctctggtacaaattccagaatatcgtcaacgccacagttcaggacatgacatatactctctacgctttcgagggaaatatacctattacgtttcagccgtgtgatgatatttgcggagaagccagcctcctgctgcaactgtgcatttgtcatatttttttctatcagtaaatggaataattttttgtaactgactgccatgtcatcctccctcatttttccaacagatttaagaaaagtttatcacgaaaacgtgattttttcaatctgtacaatcatcccatccatccttatacaatcatcccatccatccttatacaatcatcccatccatccttatacaatcatcccatccatccttatctctagataagatagatattattcatatccgtcttaataccctcagtatcattaccttgtccttttgacacttccataaccgaaaaaaagacatcccatgccccgtaaaactaacaggtctggaatgtcctttttcctctaattaactgtatttttaacaatgagaagtcaactttcactctccggctgtcggtcattcaattagacaaaaggcataccgtctccacatgtgttgtatgtccgaactggtccaccggccgcaccttccgcagctcatagccacccccacacagaatcttcagatcccttgcaagcgttgccgggtcgcaactgacatacacaatccgttccggcttcatgcgaagcatcgtctccagacacttctcatcgcatcccttccggggcggatcaacaacgatcacatccggatgaagcatgtccgcatccggcttccggctctccttttcgtagaactccggaagaacctcctccgcctttcccacgaaaaacgaggcgttggtaataccgtttaatgccgcgttgcttctcgcgtcttcaatcgcctgcggcacgatctccacgccgtagaccttccctgccttctgtgccagaaacagggaaatggttccaatgccacagtatagatcccagacggtctccctgccagtcagacccgcgtaggaaagtgccagactgtacaacttctccgtctgcaccgggtttacctggtaaaaagactgcggagaaatgtgataggcgattgccgtatctgtcagtgcaaaatcatggtcacagtcgcgcagatgaatctgatccgtgatataatccgatccccagacggtccgggtctcctcccccaaaatcacattcgtattcttccggttgatgttcacggaaatgctggtcataccttctattttacacaacgcatccaccagtttcttctcctgcggaagtgtctctctgttaatgaccaggcagaccatcagttcctttgaggtgaatccgtaacggatcagcacatggcgcaccagtccccgccctgtcgtctcatcatacgaacggaccccattctcacgcatataggaaagcaccactccaagaatctgctcattctgcgtaacgcccagcttacaatcctctaccgggataatgttatgcgtgcgcgctgcgtaaaatcccgccaccggcatcccgtccctgtccgcgccgatcgggaactgtgccttattgcggtaacgatacggctgctccatccccacaatctcctccatcacggaatcaatgagttccggcgcaaatcctccgatacggatcagattgccgcgcacctttttctgcttatagcaaagctgctgcctatagtccatcgcctggatctggcagccaccacagcgcgcatatagcggacactccggcttcacacggtacggcgacggttctaaaatctcctgcaccctggcatagccgtagttcttcttgagcttcgtgatgccggcacggatcgtatccccgatcacagcatctttcacgaaaaaggtcatcccctcgtattttccgatgccctctccgtcaacgcccatatcttcgatctttaactcaatactgtcgtttttcttcatatcctgtgatatacctatgactctcttcctgatctgcggatattgctctccagcaggcggttatatccctgccactccagattgttctccggaacacttgcaaaaatctcccgtattgtctccatcttggcgtcaatattgtccgcaaaactgagtgccagtgcctccgcaagtgccggtttcttcggcgaaccgtattccagttctccgtggtgagctaaaatgcagtgcttcaactcattggcggttcccttcgggaatcccggaatcgtgcggatccgctctccgaccatctcggcgccgatcatgatgtgtcctaaaagctgtccctcatccgtgtaatcgttctccgggaacgtcgagagttcctccagctttccgatatcatgaaaaattgccgcagacacgatcagatcgcggtttaatatcggataggttgccgcaaaataatcacagttcttcgtcacagagagcgtatgctccagcagtccgcccacaaatccgtgatgcacgctcttcgctgcggaatgaaacttgaaccgtttttcaaaatccttatcctcgacaaaaaagctctccagaagctttcttaaatacgggtgcttcacggaagcaatcagtccgagaagctctgtatacatcccgtcgatgtcctttttggataccggcagataatctttcggatcgtattccccttcctgcaccttgcgcacacgctttacgttgagctggagatttccctgaaaacttgtgatgtctcccatgactgcgatgtagtctaacgaatcaaactcatcgattccaaccgagcccggctcccagatcttggcgtccagtgtaccggtcttatcctgcaggatcagattatcataaggctttcccgcctttgtcagcgctgactgctttaccttgcacaaatagatttcgttgattctctcgccctcacgcaggctctcaatatacttcatttctgacctcatttccataatatggcggtgccgcaagacaccgccttctgttactatcctctactttaacactccgacctgtaccgtacaggtgatctcctcgtacttctccgcgccctgccgctgtacaacgatctccacctcgtcgcccggtttcaatgccagaagcttgctctcataactgtccaccgtgtagacagcttctccatccatctctgtaatgacatcgccgctctgcagtcctgccgccagcgctggtgaatccatcttgacttccttgatgtatgcacccttcggaatgtcgtattccttggcggttgccgcagaaaccgtcgtcagtcccagaccgatatacggaatgtcctgattgttggacagcttctcgatcaactgctttaactcggagatcgagagggctgtgagcgtcgtctgatcctcctcattgccgtaatcctgcattaccagaccgatcacctcgccgttcacattgatgatgacgccgctgccgctgctgctgcccacaatatccgtcgtaaagacggtataattattgtcgatcgtggaaatcacattgttggtagatgtaatattccccgtaaggatcgaatagttcgttccgagcggacttcccaccgcaataaccatggttccctgcattgtagtcagtgaattcccgagcttcgccaccgagattgcattcatggtatcctcatccacctgactgcgcggcaccgagagcactgcaattcccgtattgccgtcgtagtgcttcatggacgcttccaccgtcacatcattgatgaaagtaacatagacctcctgtgcatctgagatgaccttgcgctcagttaaaatcagaagttcctgaccgctgtctgcaatgataatgccggatgcctgtcctctgctctcgtaagaattgttgaaccagtccgtgtcgctcttgacccccgtcacggtcacgacaaagcggtttgcttctcttcccaccgcatacagcttgttctgcacgttctgtacatccgcaatctcaagctcctggggctgctgtagcggcggttcctcggaaggtacctgtggttcctcggatgtctccgtctcctcggatgtctctgtctcctcagtcagctccgtcagctccgtcaccgcaaccgaatcctgcggaatggtgaccaccggttcctcctcggggtaaaacagtgattcaaacttaggctgaaaatacgcgaaaaccagacttgctatgattccaaaaacgactgccatcagggcaataaaacctgcctgcatcagcaatcgcttcttattgaccggcttttctttgattttttcgttaataaaagaaaactgatcgttatccttttgctgcatgatttcctcttttctgcatgtatttacacacgaatttctgaaaaccgtaccagtaatcattataaaatgaatcacatacgcttgcaataggattctacaattcttttcaggttctgctttccaagactcccggaatcatatataataagaaggacataaccatgtgacaatcaaatcaaaggaactgctatgaacgaaaaagtattacacaccttagaatataacaagattctcgatcaactgaccgaatatgctttcagcgctgacgccaagtcgcgctgtcagaagctgcgcccgatcaccgaccgcgcgcagatcgaacagctgcagcagcagacatcggatgccttaagccggctgttcaaatacggctccctgtccttttctggagttacggacatccgcgattcgctaaagcgcttagagatcggcggcgccttaagcgccatcgaactgctgcgcgtctgctccctcttagagtccgcgaaacgcgcgaaggcttttgccagatcacaggacgacaacgatcagccggacgattccctgaccagtctttttgccggcatcgagcctctcacgccgctgtgtgacgagatccggcgctgtattctctccgaggacgagattgccgacgacgccagcagcacgctgcactcgatccggcgctccatgcgcggaatgaacgataagatccgcgcacagatgaactccatgatcaacaacaccacgaccagaagctatctgcaggacaccgtcattaccatgcgcgacgggcgctactgtctcccggtcaaagcggaggcaaagtctcttgttccaggcatgatccatgaccagtcctccaccggctccacacttttcatcgagccgatggctgtcgtcaatctgaacaacgaatacaaagagctgcagctccgtgagcaggaggagatcgaggtcatccttgccggcttaagcaatctgaccgcctcctacgccacacagctgctcgccgactatgaacttctgaccgagctggactttatttttgccagagcggctttcgcgcagacatacaacggggtcgccccgctttttaatgatgacggacggattcacatccgcaaaggacgccacccgttactcgatccgaaaaaggtcgttccgatcgacgtacggctcggcgaggatttccgcctgctgatcgtgaccggtccgaacaccggcggtaagacggtctccttaaaaaccgtcggtctgctgacgctgatgggacagtccggcctgcatattccggcgtccgagcgctcggaactcggtatttttgacgaagtgttcgctgacatcggggacgagcagagtatcgagcagtcgctcagtaccttctcctcccacatggtcaacatcatccgtatcttagagcaggtcaacgaccgttctctggtacttttcgatgagctctgtgccggaaccgatccgaccgagggcgctgcgcttgcgatctccattctctcgaagctccacctttacggagcacgcattatggctacgacgcattacagcgagctcaaggtctatgccctctccacaccaggcgtggaaaatgcctgctgtgagttcgacgtggcgacgttaagtccgacctaccgcctcttaatcggtattccgggcaagagcaacgcgtttgccatctctgaaaagctcggtcttccgtcggatctcattaccgacgccaaggggcgcatcagcaagagtgagggcgattttgaagacctgatcgcagatcttgagaagagccgcagcacgatcgagcgggagcagttagagatcaaccagtacaaagccgagatcgagtccttaaaggaaaagctggagcagaagcaggagcgtctggattccagccgcaacaagattctgcgcgaggcaaacgagcaggcatacaatatcttaaaagaagccaaggacgtcgccgatgagacgatccgcaattttaacaaatacggcaaggcgggcgcaccggtcagcgagatggaaaaagaacgtaccaagctgcgcggcaagatggacaaagccgcacagaagatgtccgagcagaaaaaagcttccgtaccgaaccacaacgttccgaagaagctgcgcatcggcgacagcgtcaaagtcatcagcatgaacttaaaaggcaccgttcattcccttccgaatgccaggggcgacctgtatgtgcagatgggaattctgcgctctctggtcaacatcaacgacctgatccttctggaagaggatgccgcaccgggcaccaagaagttccagaagaccagtgccggcaagatcaagatgagcaaatccgcctccgtctccacagagatcaatctcatcggtaagacgaccgacgaggccattccgcttctcgacaaatatctggacgacgcttatctggcacatctgccgtccgtgcgcatcgttcacggaaaaggcacgggcgcactccgcaacgcggtgcaggctcatttaaagcgcttaaaatatgtcaaatcattccacctcggcgagttcggcgagggcgatgccggtgtcacgattgccgagtttaaggactgatatttaaaataaaaatgaggagatgatgatatggcagcaaaacagaaaattctcatcgtagatgatgacaataatatcgcagaactgatttccctgtatctcacaaaggaatgtttcgatacccggatcgtcaatgacggcgaggaagccatgatcgcttttgatcagtacaatccgaatctgatcctgctcgatctgatgcttcccggcatggacggctatcaggtctgccgtgagatccgtgcgaaggcaaatgttccgatcattatgctgtcagccaaaggcgagatttttgacaaggtactcggtctggagctcggcgcggacgattacatgatgaagccgttcgactccaaggagcttgtcgcgcgcgtcaaggcagtgctgcgccgctatcagccggcaaagccggaggaacctgccgcagagttaaaatgcgtcaagtacacggatctggtggtcaatctctcgaactactccgtcatctacatggggcaggccgtcgatatgccgccaaaggaactggagcttttatattttcttgcggcttcgccgaatcaggtttttacaagagagcagctattagaccacatctggggttatgaatacatcggcgacacgcgtactgtggatgttcacgtgaagcgtctccgcgagaagatcaaggatcatgccaactggagcctcgcaacggtctggggcatcggctacaaattcgaggttcgtgacctatgaaacgtaccctttaccccaaactgctcgccggctatctgatgtacggtctgatcggttttctcatcatcacaacctttacctaccacattacgtttgcctttgtggaaaaaaaggaggctgccagcctctaccgggaatccgccctgatctcctccaactatgccgggaattatttttccaagaccatgacgctggacgagatacagacacagctttccaccttaagcacctatctctccagcgaaatctggatcgtggacacgcgcggcagcatcattctgaacacggcggcgccgggctgtgatcccacaccggttcccggcttcaacattaccgacttcggaagccgctattatcagaccggcacgttttataaccagtttacgtcagagatgctaagtgttttctcgccgatcaccgtcaactacaaggtgcgcggctatgtggtcatccacaagccgaccagcagtctcgtgtcctacgcgaacggacttgtcgccatcgcttatgagacgcttgggcttctgtttctggcagcctttgtggtactgattctgtttacctatgtggtgtacataccgatccgcaagattacaaaagcggcggacgaatatgccgccggcaactttgaaaaaaagattgatgttcactccaatgatgagatcggctatctcgccgcctcgctcaactacatggcgaacgaactgaataccctggaggacgaccagaaaaagttcgtctccaacgtctcgcatgatttccgttcgcccctcacttccatcaaaggttatgtggaagcgatgctcgacggcaccattcccgtagagatgcaggacaaatatttaaacatcatcctctttgagaccgagcggctgaacaagctgaccaagagccttcttgagttaaacaaattcggctcacacggcacgatgctggacatcacggatttcgacatcaatcacacgatccgcatgacagtccagacgttcgaggggcgctgcatggaaaagcgcattactttcaacctgatcttaaccggcgagaagctttttgtctccgccgatatgagtaagatcgagcaggtactctacaacctgatcgacaatgcaatcaaattcagccacacggactccgcgatcacgatcgagaccacggagaagaacgacaagatcttcgtctccgtcaaggacaccggcatcggcatcccgggcgacagcatcaaaaagatctgggagcgcttctacaagacggatctctcccgcggcaaggacaaaaaaggaaccgggcttggtctctccatcgtaaaggagattgtccaggcacacggcgaaaacatcaactgtatcagcacggaaggcgtgggaacggaatttatctttaccctgccgttagcaaagaagctgtcccatcaggcgggcagttgactttggggcgataagttatattacaggaagcacttgatacagatttcggctggaactgcatatgaaacattcgttggagaaaaatgtgtgtatttcttccagccggatgactgcatctgattccgtgtctcttccacgtttggactctcccggagtgtgtccgacaagccacagacaatgagcggactttctagtgtccctaatggcaccgcttcacagacaatataaaaccgcgcgaaccgaaactcgttggcatctgctattgaaaatagggcagatgccaattcagacatcggcttcgcgcggttatgttttgttcgacataaagatggcataaatgccatctgttgtctggtgccataagggacacacaaaagtcctaaaattgtctgttggcttgcggacatagtccgtagagtgctccaaacttggaaagacacggatcatcgcagatgcagtcaccggctggtaagaaatgccgcattttttgaacagaatgttccataggcattccatccgaaatcgtaggggtatgcttctcatagtataacttatcacacaaagctgcttacctgcttcgtgcggcagcttctttcagatggctccgtcccgcgttctatacacatgcaaatgctgctgattcttccttgagattctttgccacggtactgttctcctccatctgtccgtttacagtggacatggactgtaccagggaatcaatgttcgtggctgcatcggtcacgccatttgcggattcttcgaccgcacggctgatgccctcaattgcctctgtcatctccatcattgtcgccagtatatcctgcgcctcgcccgcatactctgccatcgtgttgtcgatgtgggtcgcatcatcattgtactgctgaccaccctgcacaaacgcacggtaatccggcaggatgttctcgttgatataaccaacaatcttctccgaagaaacaaccagtccctgtactgcctcaattacctgctcattgatcgtctggatattgttcgctgtctcacgcgaagaatctgcgagctgtctgatctcatctgctacaactgcaaatccctttccggcttcaccggcacgcgccgcctcaatcgatgcattcagtgcaagcagattcgtctggctggaaatatttaaaatatccgccgtcagctgtgcgaccttctccacactcttggaattctcgagcgcctggttcatctccgtcgtaatctcgccgatcatctcgttggtgttgttcatgttctctgtcgccgtgtgctcaagctccgtcgcacgcttcttcatatcctgcgcatattgtgacataaccttggtctgatctgccatcttctgtactttgccttccgcggcggtcgtattctcgctgacgctgttcgtcgttgcggatacctcctccatcgttgcagaaagctcttccatgatcgcggaaatatcattggcattgtcactggacgctgcaacgctacttgctacatttccgacaactccgtcaaggacattggaattgctgatgatgttggacatgatattctgcagcgtctcgataaaatgattgataccgatcgatgactgcccgatctcatccatcgactttaccgtaacgcgctttgtgaggtcaccgtgtccacctttgatctcatcaataatctctgtcagttcactcgtctgctttctgagcggctttacaaccgtcttgataatcacaacaaccaccatgacaaatgccacaaaagaaattgccagcaggatcagcgatagtatcatattctggttgtacagatctttctgttcctgaatattctgcttcaccaattcatcgttgcgagatatgagcgtatccatattgaccgcaatcgtatctgaccactccgtcatcacagaatttgcctttgccaccgctgctgcagaatcaccggccatcgccgtctgcatcagttccacggttgtcccctgcgcctctgtgagcagatcaaatgtctcattcataagctggatatcatctgccgtaaaatagtgatccatcgccagaagctccttttcatagctgtccacgttcgactggtattccgtcagctgggatgccacatactcatacagatccttgctcggctctgcgcagagcgcaagcgtaagcttctgcgtgttggcaaaagcaagattgatctcatccatacagattgtcgcacgtacaccctctccggagatctgattgctttccttctgaacggcggtcatggaataaagactcacgcctgcaatcataatcgcgatgcacccaagaaccgcaaccggtataatgagtttggcaataaccgatgattttttcttcatcctttcgtatcctccattaaaattgtctatagccccattttatcatgatatgcggacatattctattcatttttttaacgaaatctatacattttaaaaaaatcctcgtatatcttgacatccaagttagtttgtactaacataacagttgttatggaagaagaccgaaaaaaattaaccgaaaagaaattactttcctgcggaaaacgggaatttctggaaaagggatatgcgaaggcgaacctccgctcgatctgcaaagcttccggcgtgacaaccggcgccttttacttttcttttgcgagcaaggaagcgctgcttcgcgccatcttagatcccttcatcgcagattccagagagctcctttccgggcttgcccggatggaggaggaacatcccgagactgcagacgacaatgagatccagatcatccggtatctctctgcacaccgcgaggaatgtattatcctgatggagaaatccgccggcagctgctatgaacattttcatgaggaagcagccgcgatgatgcaggaatctttccgccgttattacagaaagtatcttggcgccgaaccggatccggaactgatccggattcttgcgtccatgcgcctgcacgggtatctggaattagttcatggagactacacaatgaaagaaagactgtttttagccagagcgatcggcatccacgccgacgccggcaccctgagtttaatacaatatttaaaggaagagaatgatgctcaccgttaatccggtgggcattttcttttataaaacataacaaaaaaatatttgttatcgaggaggaaaacacaatgaatcaaaaaccaaactacggaaactgggtacctgaaaaactcttgtatctgaccttcggcggcgccgccctctttctggtgcttgcactgctggcaggtcttgctttctcaaacacgcccctcgcggtcatctgcgccattctctgcgccgttctgctcgccttcggcatctatatgtatgcgtgccacgaatgctttgcctttggaaaaggcgatatgatggcaaaggttcacgcacatctggtcgcccatctcaactgggacggacacggcacgcttctcgacatcggctgcggcgctgccccgctcaccatccgctgtgccaaggcattcccggacgcagcgctcaccggcatggattactggggcgcacagtggaactacgccaaagagcagtgtgaaaaaaatgcggcaatcgagggcgtcgcttcccgcatccattttgagaaaggcgatgcggcacacctgaactatgccgacgagacgtttgacgccgccgtcagcaactttgtcttccatgaagtccactccgccagagacaagcgtgatgtcgtgcgggaggcactgcgcatcgtaaagcgcggcggagttttttccttccaggatctcttcgcccagaaaagcctctacggcgacatggatgcctttgtggaagagctgaaaaaggaaggcatttccgagatccactacatcggaaatctggaaaaaacactggattttgtccccgcctacgtgcgcacaccctggatgatcagcggcatgggcattctctacgggaaaaaataacagttccctacagctgcgccggcacttcgccgatgtcgccgtcaatgcagatcgagcgtccgtcaagttccgtgattcctttttccattgtcatcccggcaagatacgcctcctgccgtgtaaagtacgcaccttttttgtgcccggttaccggaaagtaacctaatgaaatgaatctcgcttgcgagattctccgcgcgcgagcggttcgcaaagcgatattttccttaccgcgagctgcgcatcctctcggagcgttttttatttcataggaaggttctactttcgcacatgaatgtatcatggtatttcctatgaaacaagaaagaatcctgctttgcaggattctccgcctgcggcgggttgctctagcgacataattccactccgacgcagtgcgatcctgcccggagggctttttcattcataggatgtaatttcctatgaataaaaaaaagacatgcaggttaatacccgcatgtcttcaatgtccagtcaccgtttccggagcgcaccagcacccactgccagtcctgataaatttcgtttggattgaggcttccgtctccgccgtgcttgtccgtctgaaaatctgacagaagaacaattgcctgatctgcctgatactgatctgcccattccgactccgcttcctgcacgctctcctcatcgtaccagaaagccgtcatcacacatcccggaaaatgatcgtcgaaatactcctgcgcggtatccatcgccgcactgatctcctcctgcgaataatagtcggacgctccgatctctctcttgactccgctcctcgctccgttgccaaaacatacagcgatcactcccacaaccactgcggcgagcagcacagcacccagaatctgaaagatcctctcatactgttttgtccccatgttcttttccccttattcctgtgttctctgatagaatgtgtacacattcctatctttctatcatactctgcctgactccattcgtcaatcatccgccacagaatctttcacataaatacagaaaaaacggtcggtgccttctcctagtcaatcagatcattctgaaaacgcgacaggtgctcatacggaagaatcagccggccgcggtacagcccgcacccgtcattgatgaggctgttgtcgattgccgcaaacatattgacgtccagctttgcaagctcgagttcgtgcagtctccggcagcgctcgtaggcttcatcaaagtagacacattccccctcggggatggcgtcccttctcgcccggtcgctctcctgctttttctcataccccagatgattggcgggtccgatctctgcaatatcgtccatccgcttcgtccgaagctgcatctccatgtagcacttcgcgctgttatcaaaaaacgtaatatgcagggagcggtagccgtccgggtccacatgcgcgatataatcgcggtaatacgggcgcaccgcatccgaaagcagcggggagtcgctctccttcacacctccggcgggctccgccgtaaacccgcgctcctccagaaatcccttaagcacattggcaatctcatacagataacggatctcctcccgctctccgtcgtctggattcttaagatggcacttcggcatcgagatgacaatccggtacgcgatcagatcccggaagcagttcaagcgttcctgcaattccggcactggcggatacgttccgttcttcgtatagtagtcatagatgtactccaccacataaccgttgaacttcgcctccgcacggatcaaagacttgatccttcctttgaacgtgaaggacaggtagggatattcccgcgccatatatttataaaattcccggatcttctgcgactgtgccgtcaggaaatcattgtgctcgagcaattccataatctgcgacagaaattcacagtgcctgacatccacttcattcccggtctgcgctgcggactgccgcaggtcttcggtgtattttttcaaaatttttaagacggtgtctccggagtagagataatcgtttaatgtaatcataggcataccttctttgggtttctacctatattttcagatatattttttatctcgtcaacacctttttacagtatcggtgcgctccgcaatgcgggcataccagcttcctcctggtcagcgtgtgcggtcccataacataagcacccatctcaggcacaaaccgcgtcttacactccgggcactcataagctcctgcatcacgatcaagaatgcatgcaatcgcaatgccgatcacaatgacaactatgccaactgcaatcagcgcaatctgcatccagtcctccatcggaaaagctcccgctaccacaaacattggcgtagctgcaataatcacaagcgccgataccattccggataaaataattttcttcttgctttcctgtgcttctttcactaaattcaccatattctcctccgctttctcccgatactctgtctcggaaatccgttctcctgtcagcaattcgtttacagatagatccaattcgttacataacggcagcagcagtgaaatctccgggaaaccatttccgcgctcccattttgagatcgtcttatcactgattcccagctgctctgccagctgtctctgcgtgtaaccctttttctttctctcatctgcaataaattttcctgtcttaatctgatccatgtcttcctcctttctggtctcattatgttcccgctcccacggctttcacacacacgcagcgtagaatatggtgaatttgtgcggattctacgctccgtcgagtgcctcttgccctcggtctctcggtttcatgaccggttatcctcaactcaggcaactacagtttccttctcctgcaaccgccgatccagatcccggcagctacagtttcccactttaatgcaaaaaaggctcccaaggaaaaccctgggagtcttaaatttactgaataatatttaattactcgatgattgtagcaacacggcctgatcctacagtacgtccaccctcacggatagcaaatgtaagaccctgctccatagctaccgggtgaattaactcgatagtcatctcgatgttatcaccaggcatgcacatctctgtaccagccggaaggttgcaaacacctgttacgtctgttgttctgaagtagaactgcggacgatagttgttgaagaacggagtatgacgaccaccctcgtcctttgtcagaacgtaaacctgagctgtgaacttgtgatggcaggtaacagtacccggcttagcaagaacctgtccacgaacgatctggtcacggttgataccacgaagtaatgcaccgatgttatcaccagcctgagcctcgtctaactgcttacggaacatctcgataccggttacaacggttgtctgaacatcatccttaacaccaaggatctcaaggttatcattcagatgtaatgtacctctctcaacacgtccggtagcaactgtaccacgacctgtgattgtgaatacgtcctcgactggcataaggaatggcttatctgtgtcacgctgcggatccggaatgtactcatcaactgtatccatgagttccatgatcttgtcgccccactcgcccattggatcctcaagagccttaagagcagaaccctggatgatcgggcatccctcgaagccgtactcctcaagctgctcggtaacttccatctctactaactcgatgagctccggatcgtctaccatatcgcacttgtttaagaaaacaacgatgtaaggtacacctacctgacgggaaagtaagatgtgctcttttgtctgagccataacaccatcggtagcagctactacgaggatagcaccatccatctgagcagcaccagtgatcatgttctttacatagtcagcatgacctgggcagtcaacgtgtgcgtaatgtctcttctctgtctcgtactcgatgtgagcggtagaaattgtgataccacgctctctctcttccggagccttatcgatgttctcgaaatctgtagctgtgttaccagcaactcttgcagctaatactttggagatagctgctgttaaagttgttttaccatggtcaacgtgtccaatggtaccgatattacaatgtggttttgttctttcaaacttagcttttgccattttgaatatcctccttaaaatgatgccccttgcgggctatagttattatataagaataactcggctaactctgattatataaaataatcagcggtttttcaagctatttcttaccggatttcccctgtttatgggaaaatccgggatttttacaaactgcatacggaaagcttatttggacttgtcagccaataccttctcctgtacactcttcggtacctgctcgtacttctcgaagaacatcgagtagttaccacgaccctgtgtcttagaacgcaggtctgtagaataaccgaacatctctgcaagcggtacatatgcctttacaagcttaccgccgccgatatcatccataccctcgatacgtccacgacgggagttgatatcaccgataacatcacccatgtactcctcaggcattgtaacctcaaccttcatgatcggctcgagtaataccgggtttgccttgtgcatagcttccttgaatgccatagatccggcaatgtggaatgccatctcggaggaatcgacctcatggtaagatccatcgtatacgttcgcatgaacaccgagtaccgggaatccaccaaggatacctgcctgagcagcttcctcgataccttcgccgattgccgggatgtactccttcggaatcgcaccgccgactacggtagactcaaacttgaatgtctcttcaccgttcggatccatcgggtcaaacttcactttacagtgtccgtactgaccacgtccaccggactgctttgcatatttgtattcaacatcaaccggctttgtaaatgtctctttgtaagcaacctgaggtgcaccaacgttcgcctcaaccttgaactcacgaagcagacggtctacgatgatctccaggtggagttcacccataccagcgatgattgtctgaccagtttcctgatctgtatgagcacggaatgtaggatcctcttctgcaagttttgcaagagcctcacccatcttaccctgtccagccttggtcttcggctcgattgcgagctcgataaccggctccgggaactccatggactctaagattaccggatgctgctcatcacagatggtatcacctgtcgttgtgaacttgaatccaacggctgcagcgatatctccggagtatactttctccagctcctgacgcttgttggcatgcatctgtaagatacgtccaacacgctcttttttgtcttttgttgcgttcagtacataagaaccggagttcattgtaccggaatatacacggaagaatgcaagctttcctacaaacgggtcagccatgatcttaaatgcaagtgcggagaacggctcttcatcggaagagtgtcttactacctcattgccatctaagtcaacacccttgataggcgggatgtcggtcggagccggcatgtactcgatgattgcatcgatcagcttctgcactcccttgtttctgtaagcagatccgcagcatacaggtactgcagtacactcacaggtagcttttcttaagaccttcttcatctcctcaacggatggctcttcaccctcgaggtacatcatcataaggtcatcgtccagctcgcagatcttctctaccagctcgctgcggtaaagctctgcgtcgtccttcatatctccaagatcatcggtaacggtgatatcatcacccttatcgtcgttgtagatatatgccttcatctcgaacaggtcgatgattcccttgaaatcatcttccttgccgatcggcagctgaagaacgattgcgttcttacctaatcttgtacggatctgatcaacagcgccgtagaagttcgcacctaagatatccatcttgttgatgaatgccatacgcggtacgttgtaggtatcagcctgacgccatacattctctgactgaggctcaacaccaccctttgcacagaagacgccgacagcgccgtccagtacacggagtgaacgctctacctcaaccgtaaagtcaacgtgtcctggggtatcaatgatgttgatacgatgctccagagcacccggcttcggctttgtgaactcttccagagtccaatggcaggtcgtagcggctgatgtaatggtgatacctctctcctgctcctgctccatccagtccatggtagcagtaccctcgtgagtatcaccaatcttatagttaacaccggtatagtacagaatacgctcggtcaatgtggtcttacccgcatcgatatgagccataataccaatgtttctggttctctctaatggatattctcttccagccaaggtatttcctccctaaattagaaacggtagtgagcaaacgctttgtttgcctctgccattttgtgcatatcttctttcttcttaacggatgcacctgtgttgttagctgcatctaagatctcattagcaagtctctcttccatggtcttctcaccgcggttacgggagtatgttgtcaaccagcgaagtgctaaagcctgacgacggtctggtctgacctcgatcggcacctgataagtagcaccaccgatacgtcttgcctttacctcaagaactggcataacattgttcatggcctcttcaaatacctcgagagccggcttctcagccttctcctctactctcttgaaagctccgtatacaatcttctgtgctacacccttcttaccgtctaacatgatgttattgacaagcttggtaaccactttgttattgtacattggatctgctaatacgtctcttttctgagtatgtcctttacgtggcacggttcttccctccttaatcataatttactatacagaactctgtctgcattgcccggtctccagtctctggatccggaggacttcatttcgattaattcaacggtactcacaatgtagtggcaggtatctgcctcttcgtgttcgtgcggaaatatatctctgtgtgaaacaattccaacacttaccatgtgatactattggttcgctgaattacagtaactctacgctactattttgcagcctttggtctcttagcgccgtacttggaacgagcctgctttctgttagcgacaccggcagtatcaagtgtaccacggataatgtgatatcttgtacctggtaaatccttaacacgaccaccacggatcagaacaacgctgtgctcctgtaagttatgtccctcacccgggatatagcttgtaacctcgattccgttggaaagacgtactctggcgatctttctaagagctgagttaggtttcttaggagtagctgtcttaacagcagtacatacacctctcttctgcggagaagaagtattggttggcttcttctgtaaagagttgtaacctctctgaagtgcaggtgctgtagacttcttaacagatgtctgacgtccttttcttactaactggttaaatgttggcattattttcacctcctgttttatttgtatgagatcataaattgatctcggcgtacgtatgcacgctaaatcattatattaaccctatctttttttgtcaagttcttttccaaaatttccttgaatttcgcggaatacgtgggtaaaaaagagttctgcatgcaaaaagaaaagatggaaaactcccaacggatatcttccatctatctattcttccacatttttacatgtttataccaaacggtcagccatttgcccgttttctctgcttctcctgtctctcactggtcagaatcatatagattcccagcagcatcacaccgatgcacagaacatatttcggatttaacgactgtccggtcttcggcgtctcatcctttacctgcgagtcatccgccgcctgcgcattatccgccggctgctccgtctccgccgcttccgtcgtctctgccggctggctttccgcctggcttccgcctgccggtgtaatcacaaacccggaggttgcctgcgccgttgaatccgagtgacgctcatccactacgatgacataatcacacgcatgcacaaaggaaaatgacacattgccgtccgcatctgtatcagactgtcccatatactccaggatctgattatctacattataatagaacaaagtgcccagcttattggcgttcgccgcaccgacatttacggtcagctgcgccgtcaggccaaacaggttgtcgtgcgccagatgcatctgcgttgaccatccgcttccggttactgtgctctgcaggttcgccggcacattgcttgttcccagttccacgccaaaatccgtatctgctacaacgcttgtgtcaatgctgcttccgtcaatcgtccatgagattccatttcccatatccagaaccagcgtcagctgcttatctgccgccagtgtcagaatatccttcggcacaaccgtggtgccgttcatggtaatatagatcgttgaacctggatccgccaccgtcatctgcgtgtaaatcgcatcccagcccttcagttcctcatttccggtgatatatgcggttccctgctctgcaaatctggtcgtcgcaggcacttccgccgctgtcggctgcacatctccctgtgtctccgccgtcgtcgctgccgccgatccggtaccgctgctctgtgcgcctgccgctccggcactgccctttaccgcaccgctgcctcttccactgccgttgccgcttctgctgcctcttccagatgatgtgccgttactctttccgctgctgccgcttccgctgcccgtactgctgctgttattaccactgctcgtgttgctgctgttattgctgctattgttattactgctgttattgttattgctgttgtcgccgctgttattgttgttaccgctgttattattgtcgttgttattgttgttattgttgttattgttgttattgttgttattgtcatctgccggtttttccgtgtcctcggtcggcttctccgtatcctccgtcggcttttctgtatcctcggtcggtttctccgtgtcttccgtcggcttttccgtgtcctcggtcggtttctccgtatcctcggtgtcgtccggcttataatccgtcaccacaatcgcaccgtacgtctccaccagcttcggtgcagccggagcgcttcccggcacttcaatcgagtggatcttgaaagaagtattctgctcgccaaacgtttctaaggctttgccaaggcagagtgtctgaatctcactgccgtcaaacgcaccatcttccacggttgtcacgctctccggaagtgtgacttttccaagcttgcagccgtaaaatgcattttcaccgatcatcttggtaccgtcatacacctcgatggttctcgccccctgcgggcagcggtataacgtaaccccgttcgccgtgtagagtgcattgtcgtatgacataaagtaagtattcgtctcttccacgtcaatggactgcatgttgacacatccgtcaaatgcgtccgacgcaatggttttggtcgcctcgggtatcacgatactctcgagggactcacaatttttaaatgcttcttttccgatcgatggaagttccttggaaatacttaagtccgtcagtcccgcacactctgcaaatgtgccatcgccgattccttccttgctctcccacgttgcactttccagactggtacagccgtagaacacattgtctccgatctttgtcacgctgtccggaaccgtaacctcggtcagatattcacatcctgcaaatgcgttatctccgatggttgtcacactgtccgggatctccaccgatgtgatcgtcgtattgaggaatacatcgtcatcaattttcgtgatgttatccggaatgacaactgcgttctccgctccgacatacccctgcagggttgtcccttttatgacaaatccgtcctcctgaccggacgctgcactgagctctccgggatagatcatcaccacaagcatggcaacgaccagcacataacctatttttcgttttatccggtatttcattagcactctctcccatcatcctttatttcgccgcagcccgcccgtaaacctcacgcgcgatcccacgcttttactctgcttccctgcatttcttcgccaccagaaacagtcttccgtcttctgtaaaattgttacaggtcgacagggtcaatagctcgtccccgtagaccggcagatctgttccggtaaacaccgagagttgtatgatatgatcgaggtagtcgttaaacgcctcctcggaatccgcctgtataaaatcataataacgaaattcctgtgaatttcggtactgcacctttgccagacagacggcaaacacttcataggtgcctttctcataaattgtatcaaatctgatctgcgcgtgctccctccagtaatcttcatccagatacttcttgagacttccgaacatcgcaccgcttttcatgttgtgtccgtagataataatattggtgctgcgctgcaccagatccgttctcggatccataaacaaggttccgttgatatcgtcctccccgtttacattgcgcttgagataataatccccgtcattcggggtaagcatgaccggatagtcaatcttcgtcccgtcaatggtgatccatccggcaaaatcactgtgctgcgccacgatggcttcatattccggcagaaccggaggaggcggttcgttctcccgctccgtctggtctaatcccgccgcaagttccggtgcatcctccgaaaaaaaggtgtcattgtccaccatctctgcggcttctgtcggattttcttttagcatcttcaaatactcattcgcctgactgccgcggtgattcgtgtaatctgaccagaaataccagccaaaacatagaatcgcagccgtcacacacaccgcaccgagaatctttctgctgcggtcctgcgccacctgccggggttcctcccccgcttgttgttccggcgcctgtgcctgcgttatattttttgccgcggattttgccacgacatctgcaatatccagaaaaaatttcttgccgactttgctgccgaacttgatcttccctgttcggatcagccaatagaggcgtagagcggtttccggttcattgagatcgacggtgttctgtatcttttcgattttcttcgcatcttcgagccctcgggcatattcctcttctgtgtcaaatgtaaaattccctatcttatatgccgccatgatcggaaccgctctccctcctctctatctttattttgtggttgttccggtaactgctccggtaaactcaccgtagtaagtctcgccgtccgccaccaggtagcttcttactttataagagtatgttgtctctgccgcaagctttttatcggtatagaaagcgtctctggtacgcgttacctgctgccactttccatctgcgccggcacggtatacttcgtatcccgtcacggcaccgtcgcccgtccagctgatggacagactgtctgcggatgcgcctgtcacaaccgccgcgcccgcatcgcacggtctgatgtcaaacgtcaggttctttgtcgcggtgtaattgccttttcctgcaactgccgccacaccggtacctgccttgcggttgttggaatacatcagtgtgtagtcgcttaaaagttccagggctttgccgtcatcttccaccgtcacggtcggcttgatgtcagatccggtatatacctgtgtctgaatcgaaccaatgtcgcacagatgtatgctcttgcgcagaatctggaaactcagttccttagtacctgcataatgggttccgcttgctgtgattaccagcttcgctacacccgcgttgatgttgtcttcataggataccgtgtaatccttatctttttccagctgcacaccgtctgcccatacttccggctccggtgtgattgcttttccggtatatgtgtaagtagaagaaatacccttcacttccagtccgtcgatcggcgtctggtctacagtaaactgctttgtaacggttcctgtatagttgccggttccggcaacctccatttcgtagattcctgccactcctgccggtctgcatgtcacggtataatcggtgtctcttacgagtgcgatctcaccccactggaatgttacattctgtgtaatctgctctgagtaggataccgtgtcctcaaatccgctcatcaccacatcttcatcggtgatgtccttcggtgtaatctcgatggtgcatttcttggttccgccatagcttccctgaccgatcagaagaagggtctgcgttccggcgctcatgccatcgctgttgttgtcaaatgcaaagctgtaggagtctgttgtcagaaccgtctcgccgatgcgtacctctgtaatgcccagatcatccggcgtataaacgcttcccgtgaacgggtaactgtcacgcagtcctacaatctccgccggactgatgtcgctcgcaatatgaaatgtggtctggcggtaattcgtaaatccgccggttccgttgatccgcatcagcacagtgccgatctctgtgttgtccgtgtcaaagctcagtgtatagtcctcaccctgctttaaggtgtaatcgccgcaggtcactttgacttccggaatcaccggctgacctgtgtatgcctgattcggaatcggatccaccgtaacatccgcagctgcaatatcgtggcttacgatggtaaacggtgccgttacgcttcccgcatagcttccttttcctgtcacggtcacagttgcggtaccgcacgccttgttgttctgataagatacctcataatccgtacccgctgtgagtacattgccgtccagtgttacctgcacttccggttccaccccgttgtcgcttcccatatacggataggaagttccgttcgggaacgtgacaatcgctccgtcaaagctcttctccgtaatcgtgtattccacggtgcgggatcccgtataatttccgataccggaaatcaccgctgtcgctgttcctgcatggatattgttgctgtatgcaacggtaaaatcgcttccctctgtcagctgacgtacctcaacctctgttccgtactgatatgtcacaagaacagtcggcttcttttccgttccgtcataagaaaagctgtccggaatcacttctaccgcaatcaggtcggtgccggatgacggttttgccaatgatttcgccacgatctggaaggatacttcacggcttccgattacgttgcttccatcaccggtaatcacgactgtaccggttcctacattcgtattatccgcgtctgccttctttgcaatggtatagcttcttgccggcagaatgtaatccgttgatccgatggttgtcttcaatgagaactccggcacaatctccttaccggtgtactctctgcttccgatcgcgttctgcgttccgtcaagcaccttcaggtcgtccatctgaagtgggttaatatcaaaggttaccagcttgatcagaccagcatactcgttcttaccctttaccataatgcttccgccgtctgttcccgccttgatattctctccataggtcacatcataatcggacgtggacagtgtcttgttccctatcttaacggtaacctgcgggcggatctgtgttccgcggtacaggtagctgctctctacaccgcttacctccagaattcccgcatttgcaacaatgctgaaattctctgtgagtgttccggtaaatccgtttttctcatttccgattaccgtcacgctcgcagtcttatcaccgatcttcacgttgttttcgtatgtatgaatcacaaagtgctttccggatgtcagctctgttccgtagtagctgatgctcgggattgcctccaccggatctccggtatactgctgatctccgattgccacctggatgcctgcctccgaaagatccgctttgatcggaaccgtcttctccacgcttcccgcaaagcctcccatacccttgatggtaactactgcgttgccgacccagctgttgtctgcatagaccagcgtatagtcggtatctttctgaagtgttgttccgttcagcacaacactgatctgatcgtcaaacgtgatgttcttatcgccgattgcaatgtccgtctctccggcattcacataatctttaaaccacagttcatccggaacggtaatctcggcgtccgcaatgtttgcgcagatcttaaaggtcttcttcacgcttcctgtgtaattgccgattcccttgagaatgacaaccgcgtcggagccaatgctgtcgttcttctcataagtacaaatataatccgtacccatgacaagttctgttccgttatagtacagcttcggctgcggtgttgccgttccgtccaccagcggctgcggttcgatcgctccgatcttaaagccgtttgccggtgtatatccgccattgccaatacttgcaagtgtgatcgtaaaggttgtgcttctcgatcctgtaaagtccgtaccgtcctttgccgttgccgtcagcgtcacggttccgcggctggtatgatccgccccgtaggataccgtgtaatccgtcgtgctgatcttctgtccgtcataagtaagcttcacttcaggctctaccgggcttccggtatactgtgtctgataacttccatcggtcactccgccgacagagagctctacgctgctgtccgtaagatctctcggtgcaatcgcaaaagtcttctgccatacaccgacgtatcctcccagaccttccacgcttaccgttgcggttcccgcgtggatattatccgtatatgtcacggaatagttagaatcttttaccagctttttgttgccctcgatccgtgttaccgtcacctccggctcaaatgcacttccgtcataaacatactgtgtgccgtcggtgagtgccgggcagctgatcgtaaatttgctctcgtttgtgatgagctggccaattctgaattctgccgtcttgcttccggtaaagttgccggttccggtcactgtcaccgttgcggttccggttcctttgttgttcgcgtaagccaccgtgtaatcgttgaccgggcttaacgcataggttccgtctccaaattcatagcttaccgacggtgccggtgtgacagccattccgttgtactcctgcgcgtcgatcggtgcgatctttacctccggctctgccagattcttcggcgcaatcgtataatctatcgtaaaggttccctgatagtttccttttccggtaatcgtcatcgttgcggtcccggcatccacattattctcgtaggaaatcttgtaatcatcctcgccgagctttttcttcagatctgtgcactgtaccgtaggtaccggtgtaatctcttccgaagtgtatgtatagctggactttaatccgccaagcgtgcagttgttgtccaggcttctcggcagaatcgcaaatgtcaatattctgtcatctgttccgtagtaatctcccttaccggaaacggtgatggatgcctcgccggcattcaggttgtccgcgtaggaagactcgtcatacgcgatcactttctcgatctcatcggctgtcgtaagctttgttccatcgctcagcgtcagctcggtgatcttcggatacagacgctcgccggtgtaggtcgtctcgttctcatccaccttccagctgatgatctcgtccagggattttccgctgatggtgaatacaataatcttcgttcctgtgtagttgccgttaccctgtatggtcacatttgccatcggtcccggtttctcgttgttcgcgtagctgccagccacgatcgaatagtcggtcggcgcagtcaatgtcttcttattataagtaagctttatctcactttctgtaagggtcactgcatttccgtcgtacgctttcttgatcgcctcgtaggaaacaccggttgcaatgtccttcggacgaatcgtaaaggttgcactcagttttgtggcgccgtcgctgtacacatagcatccgtttgccgtcggctgatcctccagcgggatctgctctactgtaaccgtcgcctccccggcattgatcgcctgatccgcgttggttccgtcactgtagttgaccgtataatctgttccctgctcaaggacgctcttccagagtccgaatccgccgtccgataccgaaatctcatccgcagcaagcgtaatcggatctcctgtgtataccgggttttctgccggattcaccgatacatcataatcctcatcaagcttggatgcgagcagatacttgatctcctgcttgccatagaatttgccctttccggtaatcgttaccgaagcagtgcttccttcttttgaaatatccttgatgccgtcatactttaattcgtaatcagttccttttaccagcgtattgccctggttatccgtgagtgaaatctcaagctggttatcgtttttattgttggaataccacagcattgcccagtatggtccgtcatatcctgtcaccatcctgtccgtgctgttggttaccttaaggttcttgtcgttgatcagtgtctggatatctaccgctgtaacctcaaacgtcttggtaacaacgcctgtatagttgccgcttccggtaatcgtcatcgtgtaggttccgatgtcttttaccgttgtcggtgaacatgccaccgtataatcggttccctttttcagtgtatgatctgtctttgatgcggaatgatatacaacactctctgtcggaagcgcaatctctgctcccgtatagtcaaacagctctctgtcaatgctggcagtaatcttcgtgcttgtaagattgcactgggcaatcgtatacgtcagacgtttcgttgtaccggtcttaaaattgctgttggaatcgctcggcgcaatctcaacgctcgccgtacctgcaaatatcttggtatccgcagaataggtcagcttgtagtccgactccggaagtgttaccatgtccgcgccctgcgcaaactttacaaccaccttcggcttcacgtctgctccgtccggagaatattccatcttatagtttgcagtgcttacctcggagccatcggcatccacatagtagcataccgcctttgacatgtccgcctgctcgattgtgaatttaccggtcactgcaccgccgtatgttcccataccctgcagcgtaatggttgctgttcctgcattcgtgttgcttgcgtaagtaacggagtaatccgttccctcaaccagtcccagatcgttgttgccgctcttccaggtaatgtccggttccggtgtctgtgcattgccgttataagttacagccgctgccgtcactttctggatcaggtctgagagatcagcgcctgccgcctgatactccaccgtgtaggttccctgatagtttccgataccggtgatgacacgacggtaggttccgtttccggcattgataatatctgttccgacggtgtaatccgtccccttctccagcgtcatgccgttgtaggttgcagtgatgaccggctccttgtccgctcctcctgccgcagcagccgtcacagacacagccatgccaacttcttcctgatccttgttgccaatatcttttgccttgatctcaaaatttaccgtctttgttccgtaaagggaattttttccggtaatcgtcaatgtggcttgtccgacattgacattgtcggaatataccgcatcgtaatccgcctgggaaatggtctccccgtccaccagaagctggaatgccggtgtccactcacttccggtatatacataggaagtcttgtcaaaaacaacattcgcgtccgccgcattgcgcggtgcaccgcaatatctctctccggtatagttgccggtaccagtcagtgtaattcctcttcctgtcttgctgagggaaatcgtgtaatctgttccttcaaccagattcttcacgccgtctacggcatccgcatctgcacgcgccgtatcctttacctcttggatacaggaggtaagtgtggcagaagcgttgtccggatctgctgccgcatcagccagcaccttatcccagtcaatattgtcctgcagtgtcacttccaccgtcgcgtctgatacgtctttctgtgcaatcacgtattccttctgaatctttccgctgtaaccgttctgtccggtaatgtacaggtaataggttcccgcattcacaagcacggtcgcatccgtagccgggtcaaaagttgtcgccgcaccgccaaccatctgtgcataggaaagctggtactgatcgttctcttttaatatggtatctcccacctgtaccgcaacggatggaatctgctgtccgccgttgtataccggattctccgggctgactgtcaccgcatcctccgaaagattcggtgtgaccgtcagattacaggtgtagctttttcctgcataggttgccgtgatcgtcgtgctgcctacggcaataccttcgatggttgccgggttgcccgtactgcttacttttgccaccgtttcattgccggaaacccatgttaccgttcccgtggcattctgcagtgtaagatcctgatccgtccatccctcaccgatggtcatgctgttcttgttcagtgctgcggcagcactcttcttcacattgctgctctgtgccgccgtctgattatccgaaccggaagaacttcttccggttgtagcagttacatcataggtgtatgcagttatcgccgcactgcttccgttcactgtatacatatcctgccagccggcattgccgagaatatagctctctccctctgccgtaccgccatatacataaaaggacgctccgttcaaccggacgatcacagaaaacctggaaccattctccattacctgattcgccagccctgcggaataagtattctttccttccttcacgctgacttctttttggaaaatgctcgttcccgcatccggcgccatgccttctacatccttgtaatattccacggtagccgttgccttgctgccgtcatccacatgtgcgtagaagtcaatactgtctaacagttctgctccgtccgcattgcggtccgctgtaaataccgcagctacagcctgggcctcgcacggcgctcccgccagtaccccgtctccgttccgataggtgtttaccgttccctgtcctgcccagacagtcgtcggccattccaccatcgtcacaatcaggcatactgtcagcataaacgccgaaattctcttgcatacatccttgtacatacgcgccatctcctttgatctatccctttagcgttcgtcccattttatgaaactctaaattataccttatctattttatcgacatcttttcacggttctttaacatcttttcaaaaaaaacgaggcagccatacattatctggccgccccattctgtaatgcagatataatctgcgctttattcttctgtatcctcggactcttccggcgcattctcctctaatgtgtaattctcatctgccacatcagtgtcatcaaaatcgtcgaaatcatcgaatgcaatctcctcgttctcatcaatatccgagctcagcttgatattgcggtatctcttcataccggtaccagccgggatcagcttaccaatgataacgttctccttcataccaatgagcggatcaaccttacccttgatggcagcttccgtcagaacctttgtggtctcctggaaggatgctgctgacaggaaggagttggttgcaagagaagcctttgtgataccaagcagtacctgcttgccttctgcaagctccttgccctctttctccagaagctcatttgtatcctcgaagtcaagcgtatctactaatgttcccgggagcatatcggaatctccgtttgtctccacacggactttctgcagcatctggcgcacgatcacctcgatatgcttatcgttgatctcaacaccctgcagacggtatacacgctgtacttcgcgaagcatgtaatcctgaacggcacgcacacccttgatctttaagatatcatgcgggttgacagaaccttctgtcagctcgtcgccggcctctaagactgcaccgtccataaccttgattctggaaccgtaaggaatcagatatgccttgctctctccagtctcattgttcgtcacaacgatctcacgcttcttcttggtatctttgatattggcaacaccgctgaactcggtaatgatcgcaagtcccttcggctttcttgcctcaaaaatttcctcgacacgcggaagaccctgtgtaatatcggtaccggcaacaccacccgtatggaacgtacgcatggtaagctgtgtaccaggctcaccgatggactgtgccgcgatgataccgattgcctcaccaacctgtactgcctggccggttgccatgttggcaccgtagcacttcgcacacacacccatgtgggaacggcaggataatacagtacggatcttcacctttgtaagcggttctccgttctcatccacacccttgctcataacaagcgctgcgcgcttcggtgtaatcatatgatttgccttcacgaggacattgccctcggcatcgcagatggtattgcaggagaaacgtcctgtaatacgctcctgaaggctctcgatctcttccttgccatccatgaatgcagttacccacataccagggatctctctgcctgttccctcacagcagtcagactcacgaacgatcatatgctgtgatacatctaccagacgtctggtcaggtatccggaatcggcggtacgaagggcggtatcggacataccttttcgcgctccatgcgcagacatgaagtattccagtacgtcaagaccttcacggaagttggacttgattggcagctcgattgttctaccggttgtatctgccataagtcctcgcataccagcaagctgtttgatctgcttatcggaaccacgggctccggaatccgccatcatgaagatgttgttgtacttatccagtccggagagaagtgcatgtgtcagctgctcatccgtctctttccatgtctctacgacttccttgtaacgctcttcctctgtgataagaccacgcttatactgctttgtaatgcggtctacggtatcctgggcgtccttgatcatctgtggcttttccggcggctcggtcatatcggaaatggatacggtcattgccgccctggtggagtatttgtaacccatcgccttaacagcatccagcacctcggcagttctggttgcgccgtgaatattgatgactttctcaaggatctgcttattctgcttctttgctacgaggaaatcgacctcgagctttaattcattgcccggaatgcttctgtctacaaagcccagatcctgcgggataatctcgttgaagatgaaacgtcccagcgtggactctacgattccggtaatcttttttccatccggcatggtcttgctcatgcggactttgattctggagtgaagtgttaccgcgccattctcataggcgaggattgcttcgttgacactcttgaagaatttgccttctccctttgcgcctggtctctcctgtgtcaggtagtaaataccaagcaccatatcctgtgaaggaacggctaccagtccaccgtcagacggctttaacaggttgttcggagagagcagcatgaaacggcactctgcctgcgcttccacagaaagcggaagatgaacagccatctggtcaccatcgaaatcggcgttgaacgcggtacacacaagcggatgaagcttgattgccttaccctctacgaggatcggctcgaatgcctgaataccgagacggtgcagtgtaggagcacggttcagcataaccggatgctctttgatgacgtcctcgagcacatcccagacctcagtctgaagtctctcgaccatcttcttcgcactcttgatattatgagcggttccgtttgcaacgagctccttcataacgaacggcttgaacagctcgattgccatttccttcggaagaccgcactggtaaatctttaacttcggctctacgcagataacggaacgtccggaatagtcaacacgcttaccaagcaggttctgacggaaacgtccggacttaccttttaacatgtcagacagagacttgagtgctctgttacccggtcctgtaacaggacgtccgcggcggccgttatcgatcagggcatctacagcctcctgaagcatacgcttctcgttgcggacgatgatatccggtgcgccaagctctaagagtcttctcagacggttgttacggttgatgattcttctgtacagatcatttaagtcggatgttgcaaaacgtccgccatccagctgtaccatcgggcgcagatctggcggaatgaccgggatgaccgtgaggatcatccactccggcttgttgccggactcgcggaatgcttctacaacttccagtctcttgatgatgcgcgcgcgcttctgaccggttgcgtctgcaagctctgcctgaagctctgcggaatccttctcaagatcgatcgcgtgtaacagttcctggattgcctcggcacccattccgacacggaacgcattgccgtactgctctctggcttcctgatattcgctctcggaaagcacctgcttatactgtaatgccgtgttaccggcatccagtacaatgtatgatgcaaaatataataccttctcaagagttctcggtgagaggtcaagaatcagtcccatgcgggacggaattcccttaaagtaccagatatgggaaaccggagctgcaagctcgatatgtcccatacgctctctacgaacgcttgcttttgtaatctcaacgccgcatcggtcacataccacacctttgtagcggatcttcttgtatttaccacagtggcattcccagtccttgctcggtccgaaaatcttttcacagaacagaccatccttctcaggctttaatgttctgtagttgatcgtctcaggcttcttaacctcgcctctggaccactcatgaatcttctccggtgatgccaaaccgatcttaatggcatcgaaagagatagactggcctgttgcctctttattcattgtctctggcatttatgacactcccttctatctattcttcgtcaagaacgtcgtctgatgactcatcaaaaaactcagaatcgtcttcatcctcttcctcatcttctacgtctaccagttcctcgttctctgtatcaaactgcttctgggagaatcccatctttgcaaaggactcgctgtcttcaaatgcaaaatccttatcgccggaaatgatagaattcaaatcggtattaccgtactcactggtctccatgagttctacttcgttgcggttctcatcgagcactttgacatccagtccgagggactgcagctcttttaagagaaccttgaaggactccggaatacccggctcagggatattatcacccttgatgatcgcctcgtaagtcttcacacgtccgaccacgtcatcggacttcactgtcagaatctcctgtaaggtataagatgcaccgtaagcctcgagtgcccatacctccatctctccgaaacgctgtccaccgaactgtgccttaccacctaacggctgctgcgttactaaggagtaaggaccggtagaacgtgcatggatcttatcgtctaccaggtgatgcagcttcaggtaatgcatgtgtccgattgtaaccggtgaatcaaacggctctccggtacgtccgtcacgaagctgtacctttccgtcacgggaaatcggcacgcccttccacagtgccctgtgtgcgcggttgtcatacaggtacttcatgacttcctcgttcagtgtgtctttatattttgcttcaaagtcttcccactcgaagttgacgtaatcattggcaagctccagcgtatcctggatatcaatctccttcgcaccgtcgaataccggtgtctcgatgttgaagccaagtgccttcgcagcaaggcttaagtgaatctcgaggacctgaccgatgttcatacgggacggcacacccaacgggttcagcacgatgtcaagcgggcggccattcggaaggaacggcatatcctctaccggaagtacacgggaaacgacacccttgttaccgtgacgacctgccatcttatcaccgacggagatctttctcttctgtgcaatgtaaatgcggactgcctgattcacgcccggagacagctcgtcgccgttctctcttgtgaatacctttgcatccacgatgataccgtactcgccgtgcggcaccttcaaggaagtgtcacgcacttctcttgccttctcgccgaagattgcgcggagcagcctctcctcggctgtcagctcagtctctcccttcggagttacctttccgactaagatatcaccggcgcgaacctccgcaccgatacggataatacctctctcatcgagatccttcaacgcgtcgtcgccgacacccggaacatctctcgtgatctcttccggtccgagcttcgtgtcacgcgcttctgcttcatactcctcaatatggatagatgtataaacatcatcctgtaccagacgctcgctcaaaagaacggcatcctcgtagttgtaaccttcccaggtcatgaatccgatcagcgggttcttaccgagtgccagctcaccgtttgcggtggaaggaccatctgcgatcacttcgccaacctccacgcggtcgcccttaaacacgatcggcttctggttgtagcagttggactggttacttctggagaacttcgtcagcttgtatatatctctgccgccctcgtcattcttgatgatgatctggttggactcagagctctcaacaacaccggcttttttcgccacaacacacacaccggagtctaccgctgccttcgtctccataccggtaccgactaccggcgcctctgtggtcagaagcggcactgcctgacgctgcatgttggatcccatgagtgcacggtttgcatcgtcgttctgcaggaacggaatggatgcggtagcgacggaaaacaccatcttcggggagacgtccatgtaatcaaacatggtcttctcatattcctgtgtctcatccagataacgaccggatacggaattacggacgaaatgtccttcctcatccagcgcctcattcgcctgtgctacatggtagttatcctcttcgtctgcggtcatgtagacaacttcgtctgtgacacgcggattcttaggatcggatttatcgatcttacggtacggagcctcaataaatccgtactcgttgattcttgcatagcttgccagagagttgatcagaccgatgttcggtccctcaggcgtctcgatcgggcacattcttccatagtgggagtaatgtacatctcgcacctcgaatcctgcacggtctctggacagaccgcccggtcccaatgcggaaagacgtctcttgtgtgtcagctctgacagcgggttgttctgatccataaactgggacagctgggaagatccgaagaactcttttacagctgcggttaccggcttaatgttgatcaggctctgcggggaaataccgtccagatccagggtggtcattctctcacgaaccactctctccagtctggaaagaccgatacggtactggttctgtaacagttctccgaccgcacggatacgtctattgcccagatgatcgatatcgtcatcatgaccaatgccgtactctaaatgcatgttatagttgatggacgcaaaaatatcatccttggtgatatgcttcggaatcaggtcatgcacattcttgtgaatggcctcttttaaatcctccacgtccggatattcatccatgagctgctttaataccggatagtacacgagctctgtgatgccgagatccttcgggttgcagtccacataatgtctcagatctaccatcatggaagacagcaccttgatatttctggtctcgccctgaatccatacatacggaacagccgcgttctgaatatcatccgccagggatcttgtcacttcggttcctgcctcggcgatgatctcacctgtggacacatcgacaacatcctctgccagaacatgtccgttgatacggttgcgcaacattaacttcttattaaacttatagcgtccgacctttgcaagatcatatcttctcgggtcaaaaaacatagcagaaataaggctctccgcactctcaactgtcagcggctcgcctggtctgattttcttatataattccagaagtccctcttcgtagttggttgccacgtccttgccgaaacttgcaagaatcttcggctcctcaccgaacaggtctacgatctcctggttgcttccgacgccaagtgcacggatcaataccgtgatcggcacctttctggttctatctacacggacataaaatacgtcattggagtctgtctcatactctaaccacgcaccacggttagggatgacagtacaggaatacagctttttacccactttatcgtgagcgattccatagtagatacccggggaacgcaccagctggctgacgataacacgctctgcgccgttgatcacgaaagtaccggtctctgtcatcaaaggaaggtcgcccatgaaaatctcatgctcattgatctcgtcagtctccttgttgtgaagtctgaccttgaccttcaaaggtgccgcataagttgcatctctttctttgcactccggaattgtgtactttacatcgtcctcacacaacgtaaaatctacaaactccaggctcagatgaccgctgtaatcagcgattggagagatatcatcgaaaacttctttcaggccctcgcttaagaaccactgataggagtctttctggacttctatcagattcggcatttccaatacctctttctgtctcgagtaactcatacgtatgccctttccagctttcactggacgtattctgtttttctccattgacgtttcacctctcgtttttatttacactaagctgccccaaaagtggcagcaactgtctcaatccaccgtaaccacaagatacggtataggcacatccggcggcatacaacgcgaaaagcgcgcaataagcccaatgcaccacaatagtgcaacgtatatgatagcacaatagcaagtgccgcgtcaaggattttttaaaatatttatttcttctccgtgagtacgcaaaaaacgacgaaggaaagctctaaagccttcgctccgccgttcgccaccgcttatgagacaagaaaatttgccgccgcgcgggttctctgttccatctgttttttctgcataaaaaatgcatattgctgcagggtctgcttctttttctgttcggataccgcctgtccgtaatccagatcctcgagccggctttttcctgccgttacattcagcctggtgttggtactgtagcggtatgcatactccagtgcattgctctgtgcgcccataccgctgcgccctgcactcactctggcaagtgcatcatccacctgcgtcagatcaaaatctttcgtcacatcaaaatccgcaatcccaagtgcctgtaatgtggcatctgcagtcgtaatcttcattccgttgccggtggcatccgtcatgatattgtacttctgcgacgtgccatccagaagcggcttcgtgttaaagcttgtctgttttgcaatatctgaaatgccctgcttatactgctcgatctgcgcctgaatacttgtccgctccgcatctgtgatcgtcaccgtattggacgcccgaacaccaagttcacggatcttctgaagataatccgtaatcccgctcattgcgccatccgccacattcagcatatcttttgccgcgccaatgttgttctccccgaccttatagcttctggtctgcgtctcctgcttctggatgatcgcaagctccgccgcaccgtctgccgcccggttcacttttttgccgcttgcaaatttcccgtaatctgcataagatgtgctgcttcgctgcatcgaagtaataccgttcataaaagcctcctttctgttctcaagttccgctgctcttcctgtccgccttttctattttctttataacacacaataccgctactcttcaagtatctcctgaatgtaataccggctttgttttgcgagatcgacaaaagtgtcccccacctgcacaagcggacatgacagcttatatttgttaatcatgaccactcttcccatcctgccatcattcaggatcacgttgcgctggatcatcgtctcggcaatccgcttcagaaatgtcatcagatagttggcgtccagacggttatacccctcatcctccatcttcttgatcgcttcaaatgccgagatgcccgctttatctccctgacgcatcgtaagggcatcgtaagtatctgccaccgcaagaattctggaaatccagttgatgttatcccccattacctgcagtgggaacccgcttccattcacgcgctcgtggtgcgtcagaaccgcctgtttaatccgctggtctatgttcatcttcttaataaggttgtatccgctcacgacatgtttctcatatcgttccgtctcgtattcttgcagaaattccgtctgttcctgcccgtccttccagagttcaagaaatccaatgtcatgaagcagccccgccgccatgacctcctccatctccgcctcggcgcatccgctccaccgtgcaagaagctgtccaaaaagcgccacgttaatggtatgtgcgtacagacctgactgctgttttttcatatgaagcagcatgtccgcaagatctgtatcatcatctgcttttttcagcagtccgttcagcggctccagcagcatggaaatgttcacatccttactccggtatacaatatctttcagttcttccgaaatcgactgttcggcaaccgagaactctgcctggaactctttcagatgctgttccttcgccggcgcactctgttcctgctgttccgggcgttctttcctgcccgtcggatattccaccatcacactgtccacaaaatgtctggtcagcagcgcgacgacgtccttcgtgacgaccgctccgtccggcacaatcaccgcccctgtctttgaaaacacatcctcttttatcatcattccctcccgcaggcggttgaccgacatcctcaaacacggcatggtatcttctcctctttcccgtactttcatcctctggaaaagtactattttcctataaagtctgttagtactatcatataccaagtattttcttttgggaagtagggaatttattttcccgtagcggctgtcgccgcgcataagcaaaaacggcgcgaccgccgggaataaattcccgtagtcacgccgtttccgcttatatgcttctcgtagcttacgcgattattttaaagtaacctttgcgccctcagcctcaagtttagccttgatgtcgtcagcggttgccttgtcagcagcctctttgagaaccttaggagctccatcaacgagatccttagcttcctttaagcctaagccagttgcctcacgaacaaccttgataaccttaaccttgttcgggccaacctctgttaactcaacgtcgaactcagtcttctcttctgctgctgcgccgtcaccagcacctgctgctgcaactacaacgcctgctgctgcagatacgccgaactcttcctcgcaagcctttactaagtcgtttaactctaatacgcttaactctttgatagcatcaataaattctgctgttgtcatctttgccatgattattttcctccatttaatattgagattgtatcacgatgatacgttttctgcctgcagatccctgcggcttttttcactacattcgatccggattattctgccggagtctctgctgcttctgctgcaggagcttcctctgccggagcagcctctactgccgcgtcagctgcaccgcccttttctgcgatctgattaagaacgcgggcaagattggtaatcggagactgtaagcttccaagtaacttggaaagaagaacttctcttgacggaatcgaagagattgccttcatgcctgcctcgtcatagaagttaccctcaactacgcctgcttttacttcaagagccggagctttcttagcgaaatctgctaatactcttgccggagctgttgcgtctgtcgtagaaattgcgaatgcattcggtccctcaagaacgtctcttaagctctcgaactgtgttccctctacggcacggcttactaatgtgttcttatatactttataagtaacaccagcttctcttaatgctttacgtaactgagtatcctctgcaacggtaagtccgcggtaatcaacgactacaacagactgcgcatctttgatgttttcagaaatttcctgtacgataggctgttttaattctacctttgccacgaatcgtgcacctcctttttagattttacgcatataacaaatccgaaaggatataaaaatccctctctgcctggacagagagggatcagaatctcattctcaatgattgctcatgaaagtccctcggcaggctctatgattacgccttgcggcacctgctgtcttcggccattatatgcaatccacagatgtggatctgccactgctgtggcatctgtctcatgtgagacgactgcatccgtacggacgcaccgcgttacaacgcttctgcattataacactgtatattgcggctgtcaacacttttcgccaacaacacaaactagtttgtgatcttggttacgtttaacttaacgccaggtcccatggtagatgtaagagttgcgctctttacatactgaccttttaagctggacggtttcgctttgttgatagcacccataagggtctggaagttgtcgcttaactgctcctcagtgaaagaagcttttcctactggcacgtggataatgttggtcttgtccaatctgtactcaatcttaccagctttgatgtcgttgatagccttggtaacatccattgtaacagttccagccttcgggttcggcattaagcccttcggtccaagtacacgaccgagacgtccaacaacgcccatcatgtcaggtgtagcaacgatcacatcaaagtctaaccaaccctcgttctggatcttcggaactaactcctcgcctccaacgtagtcagcgcctgctgcctgtgcctcatctaactttacgccctttgcgaatactaaaacttttacagtcttacctgttccgtgcggcagtacaactgcgccacggatctgctgctctgcatgacgtccatcacaaccggtcttaatatgaagctcgattgtctcatcaaacttcgctgtagcgttcttttttactaagctgattgcctcagcaacatcgtactgattcgccttgtcaaaagactttacagcgtcctgatatttctttcctcttttcatgaatataaacctcctggtggtagtatcgggagaggaccctcccactatatcgttccataagaacaccgccggtgctctctgatgcattacactctcgtgtcttactgctctacgttaacgcccatacttcttgcagttcctgcgatcatgctcatagctgcctctaaggatgctgcgtttaagtctggcatctttaactctgcgatctcctgtaattttgccttggagagagttgcaaccttatccttgttcggtgtggaagaaccggacttgatgttgcaagccttcttgatcagtaccggagcaggcggagtctttgtaacgaagctgaagcttctgtctgcgtatacagtgattactacagggatgattaaatcgccctgatccgctgttctggcgttgaactgctttgtaaactcaacaatgttcacaccgtgctgtccaagtgcaggtccgactggaggagctggtgtagccttgccagcaggaatctgcaatttgatatatccttctactttctttgccattggaattgcctccttaattcattctttcctgattaggattgctcgcttaatttgcaagctttacatctgcgaaacttatttctaccggcgtttcgcggccgaaaagctcaacattgatggtcacgctctgcttgccaggattcatcgcctgaatcacgccgatggtatctttccagactcctccggtgacaactacggtgtctccctcagcaaaatcaacctcaatgttctctgtcttgatcccaagcggtctcatttccatatcggtaagcggtaccggcttcgatcccggaccaacaaatccggtaacaccacgggtatttctgacaacgtaccaagtgtcatcattcataaccatattgataagcacgtatcccggaaacatcttctttgatacggatttctttgcgccgttcttcagctcaacgacctcctgcatcggtacgcggacctctaagatctggtcttccagatgccggttctcaattgtcttgtcaatgttcgcttttaccttattctcatatcctgagtaggtatgaactacataccagtgtgcctctgccataaatcacctatgcctccattaaaaacttaaaccaacaaggaaatcaacgccatactgaatcacaaaatccagaagcgcgatcacaagacccattactacggaaacagcaacaacggctgctgtctgtcttgcaagtgatttgttgtccggccaaatgatctttttgaattcagccgacaggccgctaaaaaagctctctttctgagcagctttgttctcggtttctcccattttctcactcctttgcccaaaagcctatttggtttccttgtgtaatgtatgagtcttgcagaatctacaatacttcttggtttccattctgtccggatgagctttcttgtcctttgtcgtgttgtaattacgattcttacactcagtacatgccaatgttattttcgtgcgcacaacttccacctccattaaaattctttgtgcttttcttatgtcttttgttccctgcgaccgggcttaggttcccctcaggaaaggagtcctaaaaaaaggcataaaaaaaaagacctacttccatcgctagtctaatatatcacaatcaatatggagcgtcaaccacttttttaaactcgtgcaacaaatttattttagcactacatatagtgtgccgcaagtcttttttctgattttacaaatctatcgcgtaatttttatttttactgtaaatattttatatctatttaccgataaaaattattagaagtatatctattgtacattcaaaaatacagtttcattatatataagtaggaagcaatataaacggatttatatccctgcatatgcgaaggcatatgatttcatggaagaaaggagggattccaatggcagtcatcgacagtgcctatcagtattacctgagcacttatgccggttccggcacgtctcgctacgacacgcacaaaaaaagccagctgcgcgccgtatacaataatattgtcaaagttaataaagattcccccctttacaaaatcaattttaccagggataccggccgttttgccatcgacatcaaggagcaggcccgctcgatcgagaattttatcgcggcgctttcaaacaatgctccggacgacaatgcggaacacgctttttcccggaaaattgcgcagtcttctgatgaggacgctgtgagtgtgcagtacatcggctcgaacatggacgcggacaactccaagcagttcgatgtgacggtagaacgtctcgccacaccgcaggtcaaccgcggcgtctatcttgccccgggcgcaagcgactttgtgccgggcaattacagcttcgacttgaataccaatctgagttcttatgaattccagtacacaatcagcggcagggacaccaacgagaccgtgcagcgcaagatcatgcggctgatcaacaatgccaatatcggcttaaacgccacactggtctccaacgaccgcggacagaatgcgctttccatcacgtcgcagcagaccggtctcagcgataacgagcagtacctgtttgagattatgccggcgccggacagcggttccatacgtgccatgcgcacgcttggcatcaatgatatcacggaaatgccggtcaattcgctctttttgttaaacggtaccgaacattcgtcactgtccaacacatttaccgtcaacaacgcttttgaactgacgctgaaagcccccagtgctggcggggaaaccgcaacgatcggcttcaaagcggatacggatgcgatcgcagacaatgtgcagtcgctggtcaacgtctacaacaacatgatacagctcggtcacaattaccacggcagtcaggagtccggcaagcttctccacgatatggagagcgttgcaaagtcctatttcaacgagttggaatccatcgggctaaatctgcagcaggacggatcgatccatattgacaagagcctgttgaccgacgccgtttccgcaccagacgcgcgcgaaagttttcataccctgaataatttcaaaaacggtcttcaacgcaaagccacccaggcttccatcgacccgatcagctatgtcagcaaagtcctgattgcctacaagaatccggggcacaattttgcggcggcttatcactcttcggtgtattccggtctgatgcttgatacctattgttaaaaggaattgccgcaatacgcatagactgctttggggtgataattattattacagaaataccagagaacaaaaaagttccagaataaacagacggcgggaaattctttgaagaaaaattcacgtatttcttccttgccgtggctggcatcccattccgtgtcttggccacgtttggacactcacggagtgtgtccgacaagccacagacaatgagcggactttctggtgtccctaatggcacctcttcacagacaatataaaaccgcgcgaaccgaaactcgttgccatctgctattaaaaatatggcagatggcaactcaaacatcggcttcgcgcggttatgttttgttcgacataaagatggcatttatgccatctgttgtctggtgccgcaagggacacacacaaaagtcctaaaattgtctgctggcttgcgcacacagtccgtggagtgctccaaacttggaaagacacggatcatcacggatgccagctgcggcatggttagaaataccggattttgcgatcagaatttgccgccgcatggttatctggaacttttaagtatctgtttcttataatattacttatcagcccaaagcacgatatgcttattgcggcagttccttttaattagcgcggtccggcagtgcgccgccacctatttattttgcgtcttcacctgcaaccgtatccagaatggtgtggattctttctatataagagtgcttctcccgcaccttgtggtacccgttccatgcaatccgcttacgctcctcctcgtgttccagatagtaccccactttctcacacaggtcttccagaccatcaaagcagacgaggtcttccccctccttgaaatagtacggaatctctgcctggtagttcgtcagaagaaagcccccgcagccaagtacatcccagatgcgcagcggaatgccgctcttgatgttcggtatcgtaaaattcagattgatcttcgacatgcggaagaccttcggcatctcactccagtagtccactgacccgcaatactgaatccgcagcagatcactgacatcgctgttgctgtaaacattgaccctgtaatgctttgacagctcaatcagcgctcttctccgctcgatctctgcaatcttgaatccaagcacggtcgtctggaaaatcagccccagatccgaaaaagatccctcggatttttccagctgaaaatattcctgcagctgttcgagaatgttcgtggtcagcatcggctccacgatatttgctccgctgatgttaagctgcgcctccataacagcgtcaaaatatccccttaaatactccggcagcctgtttttgatcttgtcataggaattgcgttcataaaggcttcccacaaacgccacatctccgcggtatttccgcatctccgaatcctgtgtggcattccgtctttccggtttttccggcgccccgagcagcgcatccatccgctccgtatctaccgccagcgggagataccagatatgttttacgcccatcccgcggaactccaggtaattcgtcttatcaaacgtaaaaatgtaattgcaggcgtggaacaccgattcatggtacatactgatcagcggattgtcgcatgtccaggaaacatatttcacgcctgtgcgctcacatacattcgagatcaatgggaaatagttcaccgtaaataccatatcataatgcgtcccccggatcttctcctcgatcacccgctcaaattcaggacttacgtcatagcttccgagttcctgttcgatattgtccaccgtatgtccaagcagcaaaaaagtctgctcaatgtctctgtaattatatgctttccatcggtacatcaatatgtgcatagctgtccattcctctatcctatatattgccttctttgcagtactgcgcgcagagacttaccgcctttgttcgccttaccgcgcgcagaagcttacatttaccgctcccatcttcgcccatgtgcattcgtcaggtcagaaagcactccttcagatactccgcacggcttttccacgtatgaccgtctctcgccgcagcatatccacaatctgcaatctcctgtgcccgctccagatgtccaaacagatcaaacaccctctccggcagtgttccaagctcctgccgccggaacatcacaagttccctgccatcggtaaattcgcggcgcagataggtagaatcgtcggttaccaccaccgctttcgccagcattccattaaaaatccgatcgtgcgctcctgccttaaaccaggtcatcgtgttcaacacaattttggcatcgttcatagacggaaggatctccggcgcaagaacttttccacggtaatcaagatacgggctgccgctccactcgcactgatcccatcccgtaccgtacgccgtgacccggattccgttttccaccagaatacgcaccgcctgctccctgaaaaacgaagtggcgtaggagtcgataaaacgcatctgcacaatgatctcctgcacgcgcttgtccgggatatcgcttcgccggtctttaagatactcttcaatgacttcctccgtcgtccggtccggatggtgcaccaattccgccagcacatcccccgccatcagctgtccgtccacttccgggatggaagacagatccggtatcatttttgccaccgtataaatcggaagcgctccggcatacagaacgtcaatccctctctccgcaagcggcttgtgccggcttcccagctccactcccgcatgcggaagaaaatccacctgatggatatttttaaaatatctgcggatatattttacgtgattccggtctgtgcagagcacaaccgacgtctccggcgccaggcgcagcggcttctcatagtgaaacggatgatccatcagaatgttgagatacgggatgccgtaatattcccagacatttctggtcccacccttttgtatacacgcatcgttctcccgtacgctctgtgccggcgcaggcacctccatatccagattgtatcccagattattaaatgtcacacacgaaaattcacgttccggtgctgtactctccgcaagcagggacagcagggcatccttgctctgcggcagccgcgcgtcatatacaaaggacgcatagtccatcgtctcaaaggcttcccgcaattttccggtaaataaatcaagtgtgtcgtatacaccgatgaaatagataatggtatgcttcaagatactctccttctatgagccgatcagaacctttttcccgtcaaatgcaaatccatattttctgatccgctccctcgcaattccgtctgccacaagctctgtctcatattgtttctcttctatctgctgcaacgcccttgcaacgcacgctttcatattctcgtctctctcccggtcaaaaaccttaaattccataatgtaagaattgccgttttcttcccgcgcgcggagaataatgtcatatcttcccagaccactctccctgtttgaccgtattgaaaactgatctgataaatctgccagcaatccaagcacaaagccatagtaaaagcgctctgtctcatcaatattaccacgccctgtgcctgtgtcaaagtaactgaaggtggatagcgtgaccatattcatatagtagttcatctcttctatattatcatgcagcaacgctcttctgaaatctccatagccagtatccatatcgttaaaccattcccgtataatgcgtcgaaacataatctccacttctttgttcgtcagcatcagcacatattcctgatcgttcttttggtttacgcgtagataccccgtcgcatatagaaggctgaaaatagccgattcccgatactccaattgtgcaaagtccagttgctcgtccatctccacatgtaacatctctccttcaagaagctgttccatcgccatcttcatattctttgaagactttcggattaacgagctcaccagtttattattacttgtattcgcccaataagtatcaaagatcccctctgcatcgataaactttgtgatcgaccacggattatacatatccctgcgctgtccaaatgtaaatccgtcataccattcttttactttttccctgtaatcgagcagacctactctggcaagtcccacctttacctcttcttccgtaaagccaaatgccgtctcatatttcgtactcgtttgtgtgaccacatctatattattgaggtcggagaagatagattccttgcatattctggtaatgcccgtcagcaatgctctccccagcgatggattcgttttaaaggaattattaaaaaaagcccccacaaaagaaaccatctcatcccaaaagctattaaagtaagcttcctgaagcggagtatcatattcatccagtaaaataatgggcttatgcccataatacacatagagcaaatccgtcagaagccgtacggactgcgcagccgtggacgcatccatgtcccatgatattctgccaaaatcctgtcgttccctttccgtgaaccgcgacatgtcaagtatccgctcaaagcggcgatatacctctataataccataatttatctgccgaagcaccgcctcaaacgttgtccccttaacacctgcaaatgacagaaatataacggggaaacgcccttgcagcttgtgatagcttttctcttcccaaaccttcaacccctcaaataaatccgcacgattttcatagaacacggaaaaaaagcagttcagcatgctcagattcaacgtcttgccaaaacgtctggggcgtgtaatcagcgtagtcgtctcgccagattcccaccactgccgaataaaatccgtcttgtctacataaaacatctgatcacgtcttaacgcctcaaaatcctgaatgccaaccgcaacgctcttcttgcctgtaatccgaacggtgtacgctctcatgcgccgcaaacactcctcttctccaggacgttctacatccactggaatccaccagcggctgccttctttgtatgcaccttcaatctgcccgtttgcgcaccagtaatttaccatacgcttcgtgacagaccattctgtagctttctgtctggatgtcatatattgcattgcatgccctcccctaactgccccaattataagcccgtgggtgggaaattgcaacgtcatttcccagttacttcccagttatttccttatatgttcttatccttatatcacatgcaaggatttaatgtaggcttccaccccggatctgttatgtaaattataaacccgatctatctgtccaaaatattcacgaataaaatggcagggttcccgttgtccctgccatcttcttttaagcattttcgatatcgctatcatcctttccgcagcaccagagtcaataactctttcacaacctccgatgtacctgctcccagaatagcctgaagtgctgcttttcctacgctctgcatataagcctttaaaccggataaaatccccactgccagtaatgccagtcccattacacttaacgcctcgatccctgtcaaacatagtagaaatccaactgtagcctcaaatacaactctatttgcatcccctcatatatccaggcacgagcacgacactacccttacctaaccagatcgtagctttccgctatcatccgctttacatctccatccggcacactgccgtcaaggatgaccgtattccagtgctttttgttctgatgataacccggaatgactgcttcgtacgctttccgccagaaatcaatccactccggatctgccttgacattaatccgcatctgtccctgatattcataagtccagagaaatgcccgcttatttttccgggaacgcaccagcacccagtttggatcgtgaaacggtgtatccacatagacatccggaaatgacattccgtattccaatgcttcttctctcgttgtcatagctttttcttctacctccgccccagctcgcgtatccgctcctctgccggcgcatagccgccgcacttccggtaataggcaagcgcctcttcctttttcccgaggcactcgtagatgacgccgatgttatagtctgcccgataggaattcactccctgtgcccggcactctgcatgcccggccgctttctcaaattcgcgcaccgcctctgtgaaccgtgcgtttttcatgtaaatcaatcccatcaggaactgaaaatccgcactttttccaaattcgtcatagatattctcaaaaaacagtgccgtctgctcctgcccgctgttgattaacgcatatccgtacgtctccaccatgtcaatcacgtattccagtgcaggatttaggtcaaacgaaagcccctgcgcgaaccagccgcacgccgcgccgtattctcccatcatgtaatagctcttgccaagctgatacagaagatacggaatctgcccgctccaacgagcattcgcatctgttccggctgtctctgcctttgcgacgccgtcttttgccccggcatttccatcccagcccagctgctttaattcctgctccagcaggcggatgttgcgctccgccttttcctttttctgctgctctggcagatcgtatccggtgtgcaagatcacaaccggcgtctcatacgtccgataaccgctctctgcgccacgcagtggcgtcacctgctcatggatcctgccctcgtagtgaaaatattcttttgcgaatatgcggttgatccactcccggttctcctgctcctccccgtttctgtgaaacacattccgcctgcggatccggccgaccgcccccggatgcgcgacaatctgtttttccagcgcggacagatccagctgctctacaaactcgtcgctgtccaaaaccagtacataggaatgtgaagccttttctatcgcaaaattctttgccgccgaaaaatcgtcgcaccacgggaaatcatacagcctgtccgtgtaacgcgccgcaatctgtttcgtgcggtccgtcgatccggtatccaccacaatcgtctccagaccgtacggagcaagcgcctttaagcatcggtcgatattctgttcttcgttttttgtaatgatacagatggataggttcatgtgggattcctttcattttccggatcgtattccaccatacacaatcatacacgttactttttattttcatgtagcatgtccacaatctgctgaagcatcatattgtgaatggattctaccatcccatattgtctgaccggtacatgcacattaaaatttcccatcgccctcgctttattatccgcatcaaacccagtaaaggtaatcacatatgccccatgttcttttgccgttttaattgctcttattatgttttcggaattcccggagctgctgatgcacaccaacagatccccctcctcgatcagcgattccagttgcttggaaaatacatgttcatagccatagtcatttccaaggcaggtaagaaccgcattatcgtacaagctatatgttctcatgtctccgtttttcataaagtccgccgtcatatggcttgcaatcgcagcgcttcctccattgccgataaaaaagacccgacctttgcccgctctgaccttctcaaactgtctcgtaagcagctccatgctttcggtgtagcttgtattatccagaccgttctctccggaaaatcttatattgtcaagcaattctacgatttgttttaaataactgtcacgtatcatctgtaacctccgtataacctttcaagcgccacatttctccgcaaattgtccatcggtctattattcacgattacttcgtatcaggaaatacttgagtcaattcgggttttatagttttatagttgtatcttgcccgccagcagcaatctatcaatctttccatttgcgtttagaggcatctcttgcagtaaaataattttcccaggtaacatatatcttggtatatgttcctttaagtatgtatatatctgcttctctgtttgttccaaatctccaacgcaaaacaatacaatcttatcagcctctttttgatatattgcacagcactgcttgattccatctaatccataagtagcggtttcgatttctcccagttcaattctatagcccaaatgttttatctgaaaatcagttcttccaacatattcaagttccccaaattcattatactttacaatatcacctgttctataaattttatcttcatataatgaattaagtggattttgtgtaaatacctgaagggttttttccttgttatcataatatccgtttgccaagcaagtgccccgtatacacaattcgccttcttctccctgctgaacccttgtattattttcattcagtacaattatgtccgtattttcgcaaggctttccgattggtagtggttcgttatctgcaaacggcctatttacaacaaaataggtacatgcatatgctgcctccgttggtccatacaaattaacaaactcggtcttggtgtaatactttctccaaatattcagatgcctattgggcattatttccccgcaaaacatcactaaccgcaagtcatcaatcttctttttttcaaaataatttcgatttgttaatgtcatcagcgctgacggcacccagattaatgtattaattttatactgattgatataatcaaccaacttattcggaaccagaaacagcatttccggaataatatataatgtaactcccatacatagcggtgtatatatatccggcatcgacgcatcaaaatagaaaggtgcctggtttcccaaaactgtattcttatcaaaaggcaaatacgcgcattgccattctatgtaatcaacgatcgccctatggctcacgacaacacctttcggtgttccggttgaccctgacgtaaataaaacatatgcaggatctgtatccaccactcttcctctgtaattttcaagcacctgctgttcctcaatagccggatcatcctgtaaataaatgacttctccctcatatccagcctcgcgcaagcggctttcatactcgttttctacaatagccacttctgcctgtagcaagcgaacaattttctccaaccgcggaaccggcatttttacatcaagcggaacataataatttccgctgtagagcactcccataaatgctatatactctgctattcctttattgccgaatataatgatgggtctgttatttatgttattatttttccgcctaatacttactgctactctttgtgagcgatcatacagctcctcaaaactcaaacttttttctccgtctgagattgccactttttttccactatcaatctttctttgatccaagtactgtgttacattagttatcatattgcgtaccctcaatttgcttttttacgaactttgtaatgcttaaaatatcttgaaaatcttctaactgtaaactttccagtggaatttgtatttgatacttatcctctaattcagatatcagcaataatatctccatggaatctaaaatttcttcctccaacagcttcgtatctgtttctatttccatatatggatttatttcctgtaatatatgcaatatttcctgttccatcgttacattacctcctcaatttttcggcacaatatttccgcaactttctttctccctgcatcattagctgtttcatcaggcgtgtctggctgagcgaattcattctgttttaaactatagctcatttccaaaagctccagatcattttctcttactatactatcaattttatttacattcttagcataacgtttattaaaatccgctccgaaaattctttccccaagttcgtaattcaccggcggtacaaatggaattacttttatattattttcccttgccagttgaattatttttttcaaatactgtatcccctctgtttccacatccaattcataaaggtaattaaccctaaagtatactttggatttcgcatcggaaggaacatctctttttccaaatttattagtagtaaaaaattctgcctgaagattctttttgcgttcatgcacaatttcgagatattcttcatactctttgctgtctacatgagccttttcgtataccattcttaacaattcttcatgctgtgatcttggcaataaatgctgtttacctgttagcgtatccagatttatcataatcactaatatcttaggaatcatccccatggcaatctgcgtatgcagcaaattataatgcgatcgtaatcccattccatgcatagccaaaacttttgcccggcgctctcccagttcgtcttttaacatttctgccaggttccgcatatccgtatcttccaaagagattttcgaaaattcacaatctcccataatcaacacatctcttgtataaggacgaataaattcttctacatatttttcatataaatttgatctaactgtaaaaaaatcttcttcctttttataaccatcttcttcaagaaattcttctatttctttactattttctgcggatattaatatttttacctttcctgtctggattttctctctcattgtatccggagaaacaatcggaaattcattgatgtatcctccccatttctccttgttactatctacaaaaaaaatttttgtatagtttgttcgtttaaaaaacaacgaaaattcagttcctcgaattcctgctccccaaatagcaatctcattactttccaacattgttttatgtgctgtcatccattcacaaaaagctacatattcttccttgctgctcgaagttaccggccacgcaaaattaattttctgctccatcttccatctcctcatttctgtcaatataagcaaggattttatctcttccgctctgacaaaccgcatcgttaatcgttaccatcgaaacaaaatctccctcctccagcaaatcacccatatcccaaaattggcatttatagtcatctgcaagcttcttaagcacccttctgtttttttcataaatttccacaaattcttcatgatataatttctttgccagttgatagttgataggtgtattgataacatatcctgcaatgtcatattttctaagcacttgcaatattcttttgaaatataacatttcctctgtctccaaagataatggtcgaagaatctgaatcttcatatactctttttgaatcgtctcattgtcaacgtttttaccgtcaaatgttctttgtggagaatactgcatttcaattttataatttcttgctctttcctctgcctgctgtatgtactgttgaaaatactcatcccggatttgtcctgtttcagcgatcatcttcaacaaatccggatgttgtgttctcgacaacatatgatgaaattccgttaatgtttcaaaattgacgaaaatccataccttttggggcacatatccaagcataatctgcaaccgtatcatatgataaaagccctgcattcccatgcaattcattgccaaaactttcatattttcttttttatatgttctccacaggcagtcctttatactttccggattttcttcatcaatgattgtttcatttaaaaaagtttcacctataaccaatcggtcataaccatattgccgaaaaaattcttctgtatagcttttttcaatattggattttataactgcaaatgaatcctcttttaatccccaactatataattgcttacaaatttcttcgggatattctaccggtataagaataaaagtattttgtaattgattccttacctcgttcggatttaagatggaatgcccattaatatgatttccccattttcgttcatcattgtcgatatacaggaaatctattaacccctttttttcaagtatcatacccagcaaagtgccgcgaacactcgcgccccatactagcagctttttattttctaaaaacgatttattttctattacaaattgatcaaatgccttcaatatctctttttgtgcagtttttaatggccactccattcgctttgacatccttttttcatccgttccacaattttttctgcgattagctttcttccatgttccagaattccctcattcgtggatctaagacagataaagtccccctgaggcagcaaataacttaaatctaatatacttcctttgccatttatgatatgcctctgtaacaccgttataatttccccgtaacgagtccgaaattcatcaccaaaatactcttctccccgctcataatttatcggcataatcacaaatgttatctttatacctacatttctacagaaatctaagatatgatgcagatattccatactctctgtattttccgatatatgatacaaaaaattgagcttcatatggactcgtctctgattctcaacttccttttccgataaatgtttataacgattcggagatgacaaatctaagatacttgtccctttttctctttcttcaataacttgaagaaagtcctgcatctctttatcatccgtttttttactttttttatacaactctttcattactctgccatgctggtttttgggatacaaaaaatatcgatttcccattatgtcaacattcagcagcacataaacctcttgtaaatatttcattctgtttttgcatagtctcagaatgttataatagcttctcatatataagccatttaatgcaagtacttttgtatccccggtttttctcaatatttcgcctatcgataccttatatttctcttgcacagagactgtagacactgtgcaatctcctaaaatcaagacatgcgcatcatcatttttttcaaatgaatccagcaatttcctttctgagcagtttgtcagattaacccagtctatccccatctcaaatcccatttcttcaagctgggtcgcacattcttcatagttttccattgcaagataaacaaaatagttatctccattttgtaacagcatagggttatttatcgttgtaccgactagtcggacaccccatttttgcgaatcgttgtcacaaaaaataaaattatttattcccaactgttgcaacgtatacgcaaattgcattcccataattcccgcgccaaatattacaatttgcttatcctgtctcagtatgcttgttgcatctacaatctcgcagaaattattaaagctttcttctgctatacattctattacaatgtcttcttttcccatgacataacctgctctttctatgatactgttgcttataggttatctctaatttaacatttcctgctttgacaaaacataaagaatcgagtttctatcaaaaccgcactttttatacagatcggctccaaaccattttccccctaattcattcacttgaaatccaaccgcttctaatcttttcataaaatcatctcgtgcgtataacctgcaatgatctccctgcccgaatctgtgccagttttcttcttctgaacatccccattgttcatctgtattttctaagccaacaataagcggcacaagaacgatgcataatccttctgcctttaaaatacgatataattctttcattgcagatatgtcatctttaacatgctcaagtacatgggcacagataaccagatcataatagttactatctaccatgtccatcttttgtatatctgctttaaaagtcacattatccatatataaatctgttgactcatagatcacatcctctcttgcccgcaagtatctttctatgacagaatccggcgcaatctgcaatacctttattttttgattgttttcgcttttaatatacgacaaaaattcaataatcagtcttgccctatctgtcgaaccgcatacaggacagaaatagcgctctcggttttccagttgaaactcgcgattccaataagggaagccatatttcattctattttccctgtaataatcagatattggatcaaatattactctatttttacataccgagcaaacataaatctgtcctcttaatttattttctattttatctgccaatttttgatattgatgattgtactcacataactcctgttcatcacatatatctaatccaatttgctttgaaaaagtttttattccctctataatttcttctgcctgctgttcctctatatccttctttaaattttcacataattgtattattagttgtactccctcatattttcggttatgagaatacagcaacttttgctcactaaaacaaatttgatatatttgtttccactccgcctcacattcgtagaaatttctatggtctaatacatactcttgtaatatttccaagcacccatagcgttccgcttctgctctcattatttcaaactggggaattaccttattcaagcgcttataatcctcccaaaactcttccaatatataaatttccgctaaaatcttattctttccattttgatttacgctgtcctttgttagaatctgtcttacaagcggcatttcaacaaaaccaacttcattgtcctttgcatatcttaaggcaaattcataatcttccaatgctcgcaaattttcattaaagccgttcattttgtttattatgtcgcttcttacaagcattgtctgtgtactaatcaatgcatacgttagcataaaatcaaaaatcttaccggaagtgtatttttctggcaattttttttctggaattagcgaaagcagccttccctttgcatcaaactgaaccatagcacaatatacaagtccaacgttgtcagttccagccattttatcaatctgcatttgtaatttttctttttcccatatatcgtcgctgtcttgaaatgcaatataggttccattggcttcttttataccaacatttcttgcgcctgcagctccatgatttttttccagatatatgtaccggatccgatcgtcttttattttttttatctctgcctccgtattatctgttgacgcatcatctataataattacttctatatttgaataggtctgatctaaaacactttttacagcatatgttactttatctcttctattgtaagttggtatgataacacttatcaactcttctctcatgctacgttctctctcccacatttctaatgcattctctgttgaagctcccgaatgtaatccacattatttcctgttgtaatttcttccatatatctttttgcgttatcaaattctcccataataatataggacatcaatatttgattttccctcatccattcataagtttcatttgaaatgctgtcaaatatgtcaggttccagcagcattaaaacatttttcaaatatttgctattgcctgcattcatataacaccatgcaatatcccccattaaaattgtgcgtaccttagaattatatgcctctttccgaagaagttgtaaatctttattagcgcaaacctcgcttatcgtttttattttttggtctgtatcccaatctgctctaataatgtttttaaataactgttctatattctgccagaatagcagatcaaccattattacattttgttccgtatacgcatttaccttatgtaaaaaatgatgctctgtttctcttaaagccagacagctaaatactctattggttcctattgtccgggtagcataactgttattatgaattctataatgatacattctctcattcacaaaagccagtttcttacactcgcctaaataacacaaagcaaatgccacatctcctccgaaattatctccttttttcagtttttcccctatttctttcatatcaggcaaaatactgcaaaaaatttccctgcgaaacatcttaccccaataagttcccatataagaacgcatttctatgaattgtttttctatatcacttttagaataaaccccatccagttctccatattcatgcggagtttcccttcctgtttcctcctcataatttactgcgccacaaatagatatatccacatcaggatcttcaagtggcgcgatcaatttttcaagatactctggttcaatccaatcatcactatcaatttttacaatataccgtccgtctgctttttccgcaatataataatttgtaaacccatcctgatttacatcaaaatagtctggtttaattcgttcatcaagtgctgcatatttacgtattatttctctcgttttatctgtcgaaccattctcaactaaaatccattcaaaatcttgaaatgtctgtgataaaacactcttaatacattgttctatgtaattctcaacattatacgcctgtgtataaaccgtaacacattttgacattctacattctcccaaccctaattttatagccgactcctcttacccttgagtcctattgattctttctaatatttcttctgcatatgcatctatactatcttccggagtcattaccgtattctgtggaatataacaatttttacacgcctccattttaaatcttcctgattcaagcatatccttcataaacgcctttttctgcgccccattccatgcctcatatatcgtcgtttccttcacatttccaagtttaaatggcggtctgatatgactgcacgggtatatcgttccatccggcagcacattaattgtataaaagaccaacggacagcattgctggactttaaacgtatctccgtatttatttttttctacttctccagtcttcatatccgaatccgtccataaaggcaccaccgattccacaaaaacacgatccgcaataggcgaaaacatctcataaaacctgtctctctcatctcccacagcttcatctacaattttaatatgtatctgtgtatctcttttcttctggtaaaagtatttcaaatgataataaaaccgttcaaaatcgattttaactccacactctttataatatgcatccccgtccagaccctgcagggaaatgactaccctgtcaattcctgcttcacacaattcctctatatactgtttatccaaaagtaatccattggtatgtatctccgttctcccggtaagaccggcatttttaatataactgaccatttgtggcagtttcctgttacacaaaggctctccattatgtgacaaggcaattcttttaatctggcttggaaattcttttaactgctcaacaactatttggaacgtttcccaatccatcagacgatttttccgataatcttccgccccaatgcttgtatcataacgaaagcaatatttgcaacgaagattacaggaatcacttatatcgatcaataccgtatagggcgtatcaagcggtaatacttttcccagtacatttctatcctgactatatgattttataatattactataactcatttccagtctatccttcctgcagaacgtatttgttcatccattccttctcaaaattctgaatatatggtaacgccaggaattcctcctgctttagccgcagttctctgaccaattctatgaatatgccctggcagtcctttagatcataggtttttattttgtcgcacatactgatcatataagaccactcgctgtattgcaccagccccgtcaattccggcagtttagcactgatatactctgtcctctcacaaaacgccgccagatattcccgcatttgttctgccttccacaaacctgcattttgtgtaaaagaactgttattgctctcatgccgggtgaaacagtatttgggcagtccatacgctgccaccttattcgcatttgccatatatttgtaacagatccagatatcctcgtatttgcagtcttccttgaacggtatctgttcaaacaattctctccggatcagtttggttggcagccctgcattattgcgcttgcgctttaaaagttctgtcacagcatccgccgcgctccagatacagtattcatcccacatgctatgtggcagaatctttccatttacatccttttttgcaccgcatattgctatatctgcatgattttcctgtacaagccggtctaaaaattccagcatgtccggtgcagcaacatcatcatcatccacaaatgcaatgtattctcctgttgcattcgcaattccgatatttctcccatgcccaatgctgcttttttcaatgtgaagcaccttaatccttgaatctcttaacgcatattcatctgcaatcgttccgctttgatcgcttgacccgttgtcgacaatcacaaattcaaactgtctgtatgtctgcgccaaaattgcctcgatggatcgcgctatatacttttccctgttatacgtcaacatgatgactgatatcatattttccacctaaaatcctatcaacattacactcaaaccgtctccgaccgggattctacgcagttggggatgctcgcttacatactcatcgattgcctgcgcaacaccgctataacttttcgtataataatcatgggaaattagaagtccgcctttttccatgcgtttcccaaaccactccaatcccgctttcgtcggtttatacatatcaacatccagccttacaaacgcaaatgtttcctctattccttccgcagtttccggaaaatagcctttctttataatacactgatttggatatttcattttttctaatacacgctctacggatgtatcctgataatcccctgctttcgcctctgaaaatcccgctttcttttccgtctccacgtcccgttcatcaaatccgctgaatgtatcaaacaaataaagctttctatccgcaaatgcctgattgatgattttggctgtatctccttgaaatacccccacctctgcacaggctcctgatgtatcccttaattctctcgcatattgaaaaaaggaaagttctctattattattcacatcggatgaatacttctttatcttttcctgagcaacaccgtagttttccagctgccgacatatggaatcatacccaggcacagaagctattacgatataatcgtaagccatattcacaatctgctctgccgaaacaacaggtacaccgccgatatccgtttcctgtattgcctcattattatctgcataagcaaccacatcgcaaaactccctataaaatgcgtaagcgcgttttcccgtcggacccgcaccaaaaataataattttcttcatcgtgtgtcctattctccccgatttttttctgtaaaaataatgcgcgatccctcagtctcaaaaccaaactgggtctccttgtattcactcattgctgatcttactctttcctgttcttgcggcggaacaaaaagcaacataaaaccgcctccacctgctccgagaatttttcctcccacagcgcctgcgttcttcgcctttgtatacatctcattgataagtggatttgagataccactggacatctgctttttcaaattccatgcatcatccagcatcttgcctatttgagcgacatccccttctgccaatgcctgttccgccgacagaaccatctctaccattgcatcaagcactttctccttgtcatagatatgagctttctgctccgccagaatattggatgatactctggtgagtcctgtaaagtacaacataaaattgttctttaactgatccagcgtgtcctgtctgcatacgaccatctcattcgtaacgcttccgtctctgtgaaacttatatttacgaaatcctccgtaggcaaccgcatactgatcctgcacgccgatcggattgctcagacgttcaatctctatctcacatgcttcccgcgcaagcacttccggcgaaacatgctctcccttataagcatgcagcgcatttaacactcctaccgcaagcgcactggaagaagccagtccgatacctgccgagcttaacggaatatccgccgaatacacaatatcgatccccttctctatcccgagcatttttaatgcttcccggataatattgtgtttgatctgatccaccgaatcaacaaattcattgacggtatagcacactctgatcttatcatcaaatctcttgcacaccataatgtatacatacatgtccaacgcagtgcttattaccgttccatatccgtaacggctgtttttatagtaatcagcaaaatccgttcccccaccaaaaaaagacattctaaggggcgttttcgatattatcatctgttattctccttgcatcactttaatatatcatccacggcgtgcctcaatgtatagctgttatccacaagtattccacggcatcctgccgcatgcgccgcctgcatatcccgttcatcatctccgatcattatacactcccggaggttcagtgaaaaatctctctgcgcctgaaataacatacctggtttgggtttgcggcactcgcatccctcttcccagttatgtggacaataataaatcgcatctatggctgctccaatctttgccagatccgcctgcatcttgtgatgaatctcagccaatgtctcctctgtcagattccctcttgcaattccaggctgatttgtaatcaaaatcagacgacaccccgcctctttcagcatacgaagcgcctcttttgcgccatctatccacacaaacgcttccgcactctcaatatagtgcgctctgggtggcttgacattcaaggttccatccctgtccagaaaaatggtctttatccccgagaaaaactgctttgtcaattcgattcgttcccatgatccaatggaataatatctgtgttctgtaagagtcgcaaatagttttccgctgttgacaagtttgggatacatctctgcctcaaaattgcagtttgcatcgggtatctgttcgattacctgttttgaaataatcgcatatcctatatcaaccgcgttcaggttctcctgaacccgttttttatcatagcatcgtacacagtcatccccgtccagccttaaattgtttttcgtataatgctccttatttacatatgccgtaatctgtacggatgcattatttgtatcataatcctgctgaagcttttcaaaatcaatcgggcaataattatcgcagtacatcaacagaaaatcttcctgtaaaaagctttctgccgcttttattcttgcaccagtttcatactctactggcgttatacaatacttgattcggacaccataccgactcccatctccaaaatactccgtcactttctccggcaaatatcccaacaaaatgacaacatcttctattccaaaacctttaatctgtctgagcaggtagcccagaaacggttccccgttaaacggatacatcggtttcggatcatgttccgtaaatggtgccagacgttttccgtaacctcctgcaagtatcactgcctgctgaacattttttctcttccgcatctttccctttccacgcaaaaaagcatcctgctaccggatgctttttgatcacattatatatcttccatgattttctgacagccatccatgcgcttctcattcattatatattatatcggctatccttacaaaaactttattttcaatgcctctgccagctgctcattctccctgcggcttcttaccgcaatccggacatactgtcttccgttcgcaatctttcccgtgagatccttaatcagaatctgctcttccagaagctctgccgccagttcctcactcttcctgccattgaccagctcgcacataaaataatttgccgaggacggatataccttcaatccctcgatctggcacagcttccggtaaaaccgttctctctctttccgcagttccacaagtgcctcttcataatctttcttatacttatcaagaatctgcataaaaaattctgccatggaattgatattccagatggacaccgccttctttatccggtcgagccgctccttgtcctgcgacgccagaatcccgaggcgcagtcccggcaccccataggactttgaaatgctttttacgatgtagagtccgggataacggttcagcatctcatccgtaagcagcgacgcctccttatcctccgcgaaatcgagaaaactttcgtccagaatcagcgcaatgcggcgctcctttgtccactccagcagctgctgcacctcttttttcccgaagcagtgaccggacggattgtccggattgatcagaacaagtgtctgtaccggatgctctgcaaaatagccgatcagatcctctgccgtgtaggcaaaatcattctgtcttgcatcataaacgacgcactgctcactgcaccggttcggatactcctcgaaggtcggacggatcacgcccacttttcccggaagctcctccagcagcgccttaatcagctccgccgccccgtttccaagcacgatatgttcttctgaaataccgaatgtttttgccgccagaagacagttgacccgcatccccgacggatactgccgcacaaggatgtcaaagttcgactttaattcttccatcatgcgcgccggcggaaaatacggatttacgagatagcagaagtcctttaaatgagggaatctccagtagccgccataccgcgaagtcaattttttataccgttccccggcatctgccgcaaacagtacctccgcaatatcaagatcctgtatgtcgtcaatctcataccaccgctgtccttccaggcgctttgccctcatggtgtttttatccagcatcagaatcagcttgattaccgcttcataatactcgttattccccatgaccctggcgtacgcttccagaaacggcacatacacattccgggaaaaatctgcactcagcttgtagatattgaccgtcttgtaatagcgctccttctgcgaatactccaacagctttcccggaataaaatcgacaatccggtcgtcctcatccacaaccagacatgtcccgtccatccagttttcaaacttgtccacaagcgccagcgtctcgcgcgaatcctcaagcaacaggtcaatcagcgcttcctcaaaaatcagatccgattccagcaaaagggtatcctctttcacaagccagtcttttgccatggagagcgagtatatgttattggttctgtcatacacctcattgatgatgtattctaccggcgtatcaattcccagtctgtcgacaaactgcatcagattttcacactgatagcccacgaccattacaatcctcgacagattcttcttatccagaatgtatagtgctctctctatcaggcgcacgccgcccacttccaccatgcattttgtattgttctgagtaagctttcccagacgttttcccattcctgccgctaaaataattgcctgcataccgtcacccttcacgcattattctttatacaaatagcaatcaaacacaaaccggttattccagtacagttcgttatcaggttgtacgatctcacatctgcccccgtgctcctctgcaaattgcaggaacatctctctggtgtaaaatgttttgtccagccccgcatatacttcatcataattctcaacacacttccggcggtatgccatgtgttcgtcttttttctcctgatcgtgcacttcggtgacaacaaccatcttccccgccttcgcccacatgcgttccagcaccttctgcccgtaatcagcatcattaaaatactgaaacacactgtctgccagaacgacatcgtacctcagctctgtcggcaccctgagcgcctcctcacatcccacgtccgcctccggcaccacgctttgggctatgcggatgaggtttttggagtaatccagaccgccgagcaccgccacatgcttcaacgcggaaaatagatacagattcacaccgcttccacagccaatctcatacagactgccgatcgttcccgcacaccccgtctcgatccgctgcgccatgcactcccactgcaggaaaaacgcctcataatatccctgcacatcctgtgtatcaaatccgtccgcccgttttaattccttaaacatttcaaatacggttgcgcgattctcaatcttcgcggtccgcttcttccatatcttatcccagttgttcattgctccatgttccccggcaaacgcccgggacgcctctgtcatcccagatgcttatctgcttaaaaatgctcataaagagataggaagggcattcgtatcaacaaactgcccctcttatctctttatcgtgtctgactatttcaaaatctcaagcactgattttgcatcatcattatactgtgccagaatactctgggatgcatgcaccagaatccggttggtcgaatataataccatctccatattcatgttggtgtctctgatccctgactccgcactctgcgtattttgtgatgtgttgtccgtattgcgcacggcatgttccagacgctcctgctggctgccgaactcgtctctccagagcgccgcctgttcaatcgcgtcctgaaccatcgtgatggattccgacgccttcgcatgcgaagatacattcactttgtctgtgccaaggctctccttgctcgcatttacaaaatggatatctatcgcctgtccgttcagtgccccggactgtatgcggtaatatcccggtgccgcctgcggcgttccctccgccaacatatactgctgattgaagtgcgtcgtataggcgatgcggtccacttccttgttcagctgatccaactcatcctgaatagccctgcgatccgagtctgtgttgatgtcattggctgcctgcgtcgtcagctccaccatacgatcgagaacatcctgcgtctcttggagcgctgcatccgccgtctgcagcatactgatgccgtcctgtgaattccgggaggctttgttcagccctttcacatgatgccgcatcgtctctgatatctgcaagcctgccgcatcatcatttgctgtgttcagcttgtaccctgtcgcaagctttttggaagatttttccatcttcttcacgttatagcgcagctgcctgctctcacagattgccgccatattatgattaaccaccatgttattctacctcttccctgagatttttgatatacttctgatatttatatcgaatcatccgtgctgtttctttagcataacacttccgctactttcaactttttatttcataagtttcttaacatttgatatataatccattgtactatcaatactgaatgctcttcccatcataacctgtgcctcatcggacactaagtatccaaacaattcccggagcttttcaaatgcttcacaagcatcctgcatatgataacgtgcaattacctccgcagacggacatgccccttccaactgaggatatgaataatacaacaatgtcaatgcatagtataaaataaatttagctggcactgcctccaaaacccattcctgatcaaaccaaagtatttctccctcacaataaaatgcatttctaaaactcatatccagaaaaccgatttttaatattggtccaaatacttcctcgttctcttctattcccagatccagtgtatataatatattatccttccacgaaatttgctcagaagatcgcaatatttctccatacaccaaatctatcaatctgtaaatttcatcggtgttctcttcttttaacacgtttaaaattacgtcttccaaaagcggtttttcaatgtaatcactgaccaccatcccattatcagccctatattctactatttttatacccgcttgtttcaaaatatttacatttttgagcagttgccttatatgtgtctgtgcgcataacatcgtaagcggcttcttttcaacggtgctatccctcgtaaatcttgttgccattcgatattgttccttgcgttcgcttgttaatctcgcaaatgttatttcccctagctgactgctgtcggagcactccaccaaaaatgaatttgcaaaaaactcaaacacatgattttctacaatatccatataaagatttttttcatttgcaattaatgtgttttcaccggccgagctgtaacctctgaaattttcagaatttaccgtgtctttcttacttggcaaaacatcctgagagtaaataacggtaggcaatttataatccggaaatggataataaaagtatgtattaagaaaaccactttctctaagaagtatgtctaacgctgtttttgaaaatgtccttacccctctctcaacatccctatactgatttatcccttcaaacggtattccaacatgatcttctggcattccgcaccaatattttaaaccgtactgattctctattgcgacaagcaatttcccatctggtttcagcaactgcttaatcttaaccaaaaagtccatgtacggatttgttgattccgtataagtcccctggtattccaaaacgcctatcagtgtaatatagtcatattttttatcaaattcaatatcattcaagtttccaacaataatctcaagattttctttttcacggcaccggagaagcgttgctgttgcacgttttcttgagagttccactgccgtaacatccttacattcatcgcacagtacacttgtaattgcgcccataccacagccaatttccaatacactgctatctggtttgaatttgtaccaatttagaatattttttcgtagcggcgacaaatgataatatatcggccaattaaattgctcatagacagcattgctgtagtcttccggtctattttctgcaattatcttaattataaaatcttctacctcgccatccgaatataaatcttcgttcttataccactgcagattaaatttagggcgaggattcatttttgcaattaactcttcatacattcttctttctcccttcatcacagcataacttccaaacacttttcgcaagtatttttcacattttacttataaatgcctttacccgcttctgtatactttctctattttccgcttcattctctacccggtacagctccatctgccttggaatcatcgccgcatagggagactccctatagtctgccacctccgcctttacggtatcccgcagcgtctcatacatggaatacggcacttcaaatccgcgctgcaccgcaaacagcagcgtctcatagaaatacgtatgcagaaaatacagcttgatctcctcataatactcccggaaaaacggcgtctgcttcataaaatgccacacggcaagctgcacatctgcatgcatctgcaacgttgtcatctgacgcatatcccggcgcatggttcccacctcattctggcggtagcagtaaaaagcttccgccatgatttcaaagcggtttccgtagaacaacagcggatacacaaacagcggttcttcataaatgacatgctcggcataacggacgcccgcccgctccacgagcgatctccggtacagcttgttccaacagccgtaggtgatcttctcgctgataaggaaacgcttccgctcctcctttgtctgaatctggatgctctcgtccgcggtcgtccttcccgacgccacttttccaagtctttccgtatagtacacataatcaaactgtacgatatcggcttcgttctccaccgcacgccggtataccttctcaaggaaatccttctccacaaaatcatccgcatcgacaaacgcaagatactcccccgtcgcataaccgagcgccacgtttcgggcgcctccctgacgcagattttcttccagatggataatcatgatgctctcgggatacgcgcgctcaaattcctccagcagcgcccatgtctcgcccgcatcgtccgatgcgtcatccacaaaaatcagctccagtccgtcgattccgatcgactgctgcaccagcgacagaaagcactgtggaagccatttcgccgcattgtggcagggtacaattacacttacttttttcattccgcctcccgccccctctttgcccggaaaacatactggtacacctgaaacaactgtctgtccgcaatatgtggaatctgatacagtgcgttcatcaattcttccgcttcggcatccagctcttccgtatcgtaggtcgccatcatctgtgtgacttccattccgcaccgttcaaataccctcacaatactgtccattgtgaaaaagcgcagatgcgtgcggtctaaaattcctgcgtcctggtactccagctttccgcgcagaagatcgctgattacatggcggtttaaaatattgggaacactgcacagaatactgccgtccgccttcagatagggcagtaatttctgcagaatccgctctggatcatgcaggtgctccaacacatccgccagtatgatatagtcaaacgtatctttttcatacgggatctgcatggtctcaatgtttccctgccggatatccagataatttgcaccgattttcgcaatgtcatcctggatctcaattccgcttaccttcgcgtccggccactcatacgcaatatgcgcaagcgttgcaccgcatccgcatcccacttcctgcacgcgtattctgctctctttcggctcggaaatcatcgcaatcagttcttttctgctgtaggtataataggacatatcgaagccccatttttcccggaacttctcacttgtaactgagaacgtctgcttccagatatccgagttcctgccgtttccatgaccgtaatgcacgataaaactattgtggcagaggcgcatctgccaccccgccagattcagccggatgcacagatctacatcctcgttctgccccggggaaaaccgttcatccagaagtccgacctcatccagcgccttccgtttcagcagcatcgcaaatcctaccagccaggtctttttctccagcgcattttccatggggatattcattgccgtgccgtatgttatgtattcctccacaccggcaagcttcgcctcaattctctgcccgttgatcacgctgtttgacatgcttcccgtggcgccgatccgttcctcctcatataaccccatcctaagccagaaaatagaattgggcagaacaatcgtatcattgttcagaagaaggatatcattttccggctctgccgccttgattccctgattgcacccagccggaaagcccttgttttcctggttgctcacgagtgtcatatctttttgctcccgaagccattccagcgtgccgtctgtagatgcattgtccaccacgaccagctcgtagctcgacggatcgcaggtgtcccggatgctgccgatacactgcatattcatgtctttgagattatacgtcaatatcacgatcgaaaccttatgcacgcaccaccggtcatcctgctgtacacgctctttgtgctgctgtatgatcctgcgatcgtcttcatcgctgcaataatagagcgcattttcatagcagagccacgcctggttgcaatttttgcgctcataataattgcccagcagcagatacagttcgtaatttttgtaattgtactgcagtccctgcgcgatgcaggtataggcgccttcccagtcgcccagcgcagagaaaaccgttgctgccagcacggcgagttcatcatcccattccccgttcatatactgcccgagttctcttccggcttccctccacgcattctgctcaataagttgctttaatcctgcatatcccatcccgctctattctcctgctgttttctgatgatctgcctctcccacaccatccgcaaactattttgtcagccgcttcaccgtttcaatgaccgtatcctgctgctcatcggtaagtcccggataaaccggaaggctgatgatgtgcgagtagacttcctccgccaccggacaatgtacttctctgtaaccgtgctcctggtagtacggatgatagtacaccggaatatagtggacattcactgcgataccgttctcccgaagctgctcaaacacggtctttctgtcgtgattcttcacctgtatgatatagagatgccatccgctgttcgtctccggcaactgatacggcgtcataatattcgcgcagtccgcaaacgcctcatcgtagcgctttgtgatctcccttctgcgcgcaaggaagcggtccagcttccgcatctggctgcagccaagcgcacactggatatccgtcatgcggtaattatagccgagatcgagctgctgatagaaccacggtccctcatttctcgtcatcaggtccggatctctggtaattccgtggctgcggaacagcactaatttccggtacaattcctcactgtccgtcacaatcataccgccctcgcctgtcgtgatcggcttcaccggatgaaagctgaatgtcgtcatatccgacatggagccgatgcgccgtcccttatattccgagccgagcgcatgcgccgcatcctcgatcacgatcagatgatgctcctttgcgatcgcatgaatggcatccatatcgcagggctgtcctgccagatgcaccggaataatcgctttggtcttatccgtgatcttgcgccggatgtcctccggatcgatattgtacgtctgcggatcaatgtctgcaaaaaccggcgttccgccgcagtacagcacacagttggcggatgccgcaaacgtgatcggcgtggtgattacctcatcccccggtccgattcccgccgcatggcatgccgcatgcagtgccgcagtatcgtttgaaatagcgaccgcatatttcgcgccgacatactctgccactgcccgctcgaactctgccaccttcggtcctgtcgtcaagaaatccgatttcagcacctttactacttcctcaatatcatcttcctcaatcgtctgtcttccgtatggtatcatcactgttcctccttgctgtacttttccagttccatctttgccctcttactgtaggaatacggaatgcccctgttttccttctgcatccgcctgtgaaaggatctaagccgctctgcactcattggatccggcatatgccatgtctccagctgcccgagaaccttctccttatccagcacgccatgtaagatcagaatgagaatggcatctactgatatgttaccgctttctaccgcgtgaatcaattcctgataatcctgtgccggtctgtcaaactccatgcgatgcagcaaaaagcgtaccgagagataggtccggcatatcgcttcacagctgcccgcctgtgccagaaacgacgatcttttgcttaccctgcgatccgtctgctcaatctcacagataatcgcaagcatctccagctcggagctcttcatctggctctgatgatagatcccgatggcctgactggcctcgtcccattgcccctggtctatcatcctgcggatcgccgctgccagctgactgctcagctgatcccactctccgctcgagaacagctcctccccctccggaacgttgaaaaattccggatactcttccatacagattttccggttcctgtcataattggtgagctttgcgaatccgcagtcgtgcaccacccagggttcttcctgataaggcaccacaatctcatagcctgccctgcggaattcaaacgcctgcgacacatcatagaaatcaaaatccgaaaacagatcctctctccacggcagatcatactgcgtcatcatcagcagcccgtccaccgcatcgacggtctgatccttggtctggttcggcccgcacagcaggacataggaaagatccggctccctgcagtccacttttcccacattccaggaagaatagacgacgccgttctccggaatgccgattcctccaaccatcccgatcatccccgtctccgggtgctccttaaaaatacgcagcgtcttctccaggaaacggctgtcgcggataaaaacatcctgatgcatatagactttatattttgcatcgctgcttcgcatccccagattgtacgccgcgcacatggaatccgcctcccagatgccgatcacatctatgtcatatcccgccggaacttccagatgctctatgtaatacttgcactcttcaaaatacagctcattattcacgcatataatgaatgcgattgtgtcttttctgtcctctaccggcatgattttctacctcatacatctcttttatactgctgcaaaaatgccgcaatccgctctgcgccctttccgtccaccagccttctcatccgctcaaagctctgcgccctcttcccggcgtctttcgtatagcagaccagattttcacagattacatgcggcgcatcatccttttctctcacatcccccgcataaattaacaggttgtgttctgccatctcctccgcaaattccagctgattgtccgcaaacgcaaaacagaccgtcggaatcccgcaggcgcacagttccagaagcgttgtaccgcccgccgagaccgccacctcgcactgctgcatgtagcgccacatatcgggaatattcttgtgaagtatgatcttcgggtttgctgccgccagttcacgcagcatgtcctcattccggttcatgcttccgacaatcacatgccacagatagtcctgcaattcctgcatctgtgtgccgtacgcaagaattctgcccgccatattgtaaggatcggttccgcccgtcgagagaagaatactcttctcccgtggcttatcaaaggaaagatgcgaaaactcctcccggagcggcgcatacaaaagtccggtaaggtactgtaccccgtccttttcatgcagcccctccggcgtcttctgtctctccctgcacggtatatattgaagcagcgccgacacctcgtagtgttcccttctgaaatcgtcaacatagaataccggcaccatccggtttaattccgccagatagcgcaccgtcgcacagtaggaatccacaaccagccagtccaccggctgtgcctgtaaccgctgcttcatgaccggaagttcgtcctccagcgcatcccagcgcgtctctagaatccgatagggaaatcctgcctttgcgatccgctccgtctctttttcctctgccagccaaaactcacacgtcagcccgcgcttcctgcacgccgacgcgatcgaaagcgtgcgcatcagatgtccggttgccacctgctcgttcgcatccacccgaaatacaatcatctgtctactccacctcacccggaagaatcggctctccgaagcggtacgcctttttcgccttgcgccccagcagcgtgcggtaatacttcggcttgataccgatggcaggccggatgctgcgcacattctcctcggtgaaagcctccccctccgcaatcggttttaccgcaaccagcgatctgcggtattttaaactgctcttctcatgttcggtcagctcataggtcgcctttcccttaatcacgcaggcattccgcacatcctgcaccatctgcgcaaattcaccgatctccatggaaaacgctgcgtccgggttgtcaatcgtccgatccaggcatacatgcttttcgatgacctgcgctcccacagacaccgccacaacatccgcaagtgatcccattgagtgatccgacagtcccaccggcacgccgaaccgctccttcatatccgcgattgttgccacattcatatcctcatactgcgccggatactggctgcagcatttcagcagcaccacctgctcgtttccctgtctccggcacgcctcaagtgcctccctgatctcttcctccgacgccattccgcaggacataatcatcggctttcccttgctcgccgtatactcgatcaatggaatatccaccagctcaaaggacgcgattttgtagaactccacatccagatcctccaggaaatcgaccgctgtccggtcaaacggcgtagacaaaaaatccacaccgacctccctgcacttatcccgcagcgcctgctgccattcccacggggtataggccgcctggtagagctgataataattatagccgtcccacagaccgcccttgatctgatacggttcctccctgcagtcgatcgtgagcgtatccgccgtgtaggtctgtatcttcacacaatccgcgccggcttttgccgcctcctcaatgattttgaatgcattctcaatttttcccgcatggtttgcggacatctctgcaatcacatagaccccgctgttcattttctcatatagtttcatctgtgacagccgcctcccttttcttttccacgttccaaaccgtttttcaacacgaatccctattctacgcgcttcgccttcgcctgtacctgaaactggtacgcgaaaaacaggttctcgtcggtaatctccgacagttccatcagcctgcctacaaattcccggtcctcggagctgactccgtttgaggtcatccttatctcctccgcttccagttccgtccgcagtaacatgctaagaatctctttgtaggtgaaaaaatggatatgggttctgtcgagcagtcccctgtcctcataggtaaaattgccgttgatcagcccccgcacaaccgagacatgcatcagattggggatggacgccaaaatgcttccgtcctcttttaaaaagcctttgcaatatgtcagggttccttccgggtctctcagatgttcgaggacatccccgaatacaatgtaatcaaaggtcactccgccaaaatccatctggcgttcttcaatgtttcccacggtcactttcgcaatacagttcgcaatctccgccgccgaagggttgatttccacaccgtaaagctctgcattgggataacggttctttaccccgagcagatttgccccgcagtcacacccgatctcgagaacacggatgggggcatcttccggatctgtgatgtaggaaagcagtccggcgttcggaacggcattaaagtagttcatgttccattttttcttcagaatctgccggtctgacactgcccattcctcgtcttcgtccgcggttctcttttccgcaatctgatagaagaacgcaccgccgctttcaaacagcctgtactgaagcttgatccccctgacacagtaatcccacatcacattctccgcaagggcaatcttctcatcaaaggctcccacttcttccagcattgcatactttagcagtacacagcctgcggtcagttccagcttctgcagattcatccccgccgcaatctgccctgcctgtatccgcgaaattgcctctgtgtagcttggcgcggtctctgaaccgttctgaatcaccttcggcataaccgcaccgattgtgctgtcggagtacagtaatctctgcatttctccaatagcatccggcagtatcatatagcagggatcaagcagcaaaatgtcctcatctgtgacaaactctgttttcgcatagttaagaatggtgctgtaattctctcttccctcatcgcagacaagataatttatgccgggtctctcttccagccactggcgcagcccgtcctgcgaagcgttgtccacaataatgagatctctctcctctattccggcaagcaggcggagcgcctctatttccatctgcactaatttcaactgattatgcgcgacaatgattactttcatattttctcctttatttaccgtctgcgttctgtccgattgccctgcggtaagaaaaaccgtagtcttctctctgctcttcatagccaagtttctgaaaaactttctgtgatgctatattatcattctttacttccgcaagcaattctctgcaaaatcctttttccgaaagctgctcctctgcggctgcgagcatccacgacgcatagccatttccccgcgcccactctgcaatggcataggatatttctgcgctttcaccccgctcatcccggtccgcccgcacctgtcccaccggtgcaccggcgtcttccagaatgtaaatcctgcagttctcattcttccgcttctgctcataccatttctgatgctgctcatagggaatctcttccgtatggaaagaacttgcccggacgagcggatcatttcttagctcgtacaaaaaacggcagtcctgcgcatccgccggtcttaaatgcagcccccgcatcctgtcctcctgctttgtttcacgcatcagatattcattcaggtaccgcgtcacttttgccgcacctgcggcgtttaagtgtgaccaatcaaaaaagtccgcatctgtaaatgccgtctgatccccgcccagatcaatcagatccgcgccgtatttgcggcagagattttccagcaccagatacgtctgccgcttcatctccccgctcgtcagctcacaaaactgcgccgggaacggcatgaagagaaacacggcctttatgttgtttttctgtaaaaactccagccagcgttctaaaaccgcaagattctctttgtatgtctcgggatacggtttgtgaaaaatacgctcgatggactttgcatcctctttgcgctgctcctttgacggcgtatagatttcctctcttttcgtctcacaaatctccgcgattcccggaaaccgtcccagaaagtcgcgctccaggaagtcctgccccatcagtttttcacagattctttggtcttcccatgcctcggcggcgtcctctgcccagtccagatgatgcagctttttcgtctgtgggtagaatcccagcactcttagactctgtgatccccgtgacagatcccaccagagccggtacgcgctcattccgatgatgcaatactccatccggcgtttttgtctgtccgtgatttcgtcatatgcccacaaaaagcggtaataatccgtgtacagatcctgcgacggtcccgccagacacatgatatcccgcgccagtctctcatagcagatgcccttctgctcgtagctcattccgcatacgacgcctgccgccgttgtgacctcttttttattttttatctgctgatacgtcgcctccgggctgatttcgttcatcagacggaaaagatcaaaccggagcagtcttaccttcccgaaccagtgtatccccgctatattttcatactgggaacatataatgatgtaatcactttccctctgcccgtccgaaatctgtcttacggtgccaagcagatgaacctgactgacatccagcagtttttccaccggcgcacagtccgccgcctcccccagaagccatacctgatatttttcctgctctctctttaaatccgatactcggccgacaatctcttttgcgcacacatcatccagccctccgccgctctccagatcccgggcgctcttctccagcgccgcaaacagcaggtcaatctgctccctgtatgccgcctgattgctcattccatctatgtaagcggctatttcacttatgatctgacatttgcgctcatatgcagtctgttcctgcagcagctcatccaaatctctcgccgtcatctctctactctgctcccaacattccggttaatgcctgttcaaatgtaaaatcgcgctgtacctttgcaaggccgttggcggcaatctgccgtctctcggtgtcatggctcaggtaatattgtgcttttgcatacatatcctcgatatcctcgtagatcacgcactccgcgccgttcacaaaatgttccgcgatttcttccctgtaattcgtaagtacaaaaccgccgcagcccataacatccagcacacgcagcggaattccggtctgtatgacccgaagcgcaatattcaggttgatctttgcgtcatgaaaaatatgcggcatctgcttatagtaatccgcatatccgtaatagtgaacctctgtcagacgctcgtccttctcattggaccacaatgccgtcgcaaagtggcgggacagcagtcctaagacaagaaaccgctctcttcccgttgtctcgcaggcaagcaaaaactccagttctctgcgggaaatgctgactttgccgccgctggccttcacatatgagtcatttaattccgccagcagttcgtccgttacaagatccggaatcagatagcctccatacacttttagctgcgctgcgatgatgccctcaaggcgtcccctctgataagcggacagcggctgtagatagtgctgatactccgtccggtataattttcccacaagcgcaatgtccgtctcgtatttttctctctccgcacgctcagaccgcgtctcatagatccggcggtacagttccgtatccaccgcaagcggcatgtgccttgcatcgattccccggctccggtactcctctgcctgtacccggtcaaaaaaataaattgtattgcaggaatttttcagcgtagcaaggttgcggatatgaatcgggcaatcatacacccacgaaatatatcgcacatcatgccgcgcgcataccgttgaaatcagcggtgcatagttgatggaaaataccgccctatacgcccctgtctttatttttgcctcaaactgctcacaaaacgcgtcatctttttcccagtccgcaaactgataacaaaaagtatcatagattatattcattttctgaagtgcacgctcaattccgtcattcataaatgaattccattgaaaataaagtatctttcccacacaatatctcctgatgatgtcctatatccaagcaaaaaaccggcttctggtcatcccaaagccggttctatgacgctttatttagttacttcctttgccgcttcgcccagttgctgaaataccggaattacattttcaaattctactgccattctggcatcatcctttgccgcaatcgcatcgcttaacgctacaatcgccgtgttaaaacctgccttgtcaacacggacctttccgtcattgagcgtatccagcgttccgttgacaacctgtatctcccagttgacggcatccacaatgcctttcaaaaactgatcggtatcgtccagacgctccccttttaactcttttacgataatctccatattatgcacgaggcggtcattgaactctgtcaaaacctccagtgcttctatctgttctgctctgttatcttccatgatctttccctcactgcacccgcagcacagccatcccggcttcctttctcataattatactgttaaatatatcggttcctttttccatttgcttaatatcttttttgtaaaaggaactcttatcaactatttctatattcttgcaaaaatttttcgcgttcaccaaaatagtcatgataatcagatgcaccgcaatcatggatacaccacggattcagcattgcaggaacagcgatcttgtatccccgctttgaaaattcaaagcattgggatacatcataaaaatcccattttttaaatatatccgctctccacggtacatcatactgtgttatcattaaaaatccgtccaccgcttccacgtattcacacggagccgcaacttgtccaaaaatatatgttccatatccttccgagccttgcgtatataaacttccaatcctgtcgccataccacatgacaccattctccggaaataccggtgaaccaaccagtcctatcattcctatttctctatttttaaacagggaaagtatttttttcagaaatttcttttccgtaatcattacgtcttgatgcatatagatcttatatctggcatcgctcaattgcattgcccgattatatccctctgccatactctctgcttctctgatcacaacactttcacacgaatagccctcaggaacctccaaacgttctatgtaatataacgcttctttttcatactgttcattatttgcacacatcacaaatgcaaactttttatcgttcataccaactccacctgaccacatatattattccgttacatatttccccaattcttgtaccataatttgaatactttcttcctgcggtttttcctcctgcattgctcgtagtatccagtatgcatgcctgtacatagacgaatcaatcataatttcaacaatgtttaccatcacgtcaaacgtctccattgctgtcgttcgaattgtctgtatcaaatataccggagaaacactgttttcctttataaaaccgatcagcttctctcctgcttccgtttccgcttcatccgcaaattccattcgccacagcaaaaacttaagttcacgtatataacttctgattttctccaacgtccatccttttgcaatattttttcttcctaagatggtatattcctctcctgctttcacttctaaactgtaaatctccattattgtccgcagttcaatgattctattatcaatgccaatatacggtttcacaatctcttcatttaaatataattgcatcaattcttcccgtgcgtgttcatcgcctttttgcaaaagcaaattcgtcttttctaataaaacattcaaatcaccactatggcatgtctcccatagcatatactctttctcacgctctcttgcatattcctcagatgtggtgcacagcacccgttccgtacccttctccccactcatctctttctcctccatgctttcgtaacagcactctgcatccacaaaattttatacataaagttcaccggcagataccttttcacagaattcctccacggttcctttaaaaccgaccctttggagctcccgcttcaagtcttcttccatatgccggtagaacggataatcgtggtcggccgtccccttcaccggaaccatatagtctccgtattccgccgtgagcacctcatcatatccgcacggcgccggaagcctgatatgttcaaacggcaggtataccgtcttttcatacgccgtcttagggatgtgcagctgctcccggttgagccagaacacgtaatttgtcacctcgtccgcttcctccctgcggtataacgcctgcacggcatccgtgatacgccatatctcattctgtctgtctgcatccggggcaatctgaataccgcatagttccccgaacacctttattttatcttcaagtaaattttcgttctgaagctgctcccagtcacgcagcagggcaattcccgtctccacgatttttttctgaagccggctcaattccggatctctcgggacataatccatcgggaaaatatctattcctatgcgctgatacggaaaaccgtgaaaacgctgcatgtacgtgttgatgttccacatccgttcatccgccataaccctcagatgcggcacatacgccgccatctgcaggcgcttttccccggcgtacattcccgccatgcaaaatccctgcggcagctcctccggcagaacccggatcaactccatgtaatcctcccggagcatacagatgtcaatatcatcatcccacggtatgaatcccttgtggcgcaccgcgccaagcagagtaccgtaatccgcaaaatactgcagatgataccgttcacatacatccgcaatcacgcttaatacttccagttctgccgcccaggcgcgcttcatcattgcgggaatctcaaaatcgtctctcacttccgcgcaaaaatagttctgtggaaactccattttccttctatctccttacctaagaatccatcctttgcatgtatttacatgccaagccggtatttcacttctgcaagcttccagtcctccggcgtgtcgatatcctgtaccttcatctcatccataatgtatggtatggtgttgtgtaagaccatgctgcgctccttccggaatgcttctacccgtagcagataaaactgtccgcaatcatgataataccgctccagatcctgcgagcgcttcaagcggttctcctcccacttgtatttcaccctgtcctgctcaatgacaaagcatctctgcggcgggaaggaatatgccacaaccggaaccaccccgtctgcccccgtctgctccaggcgctccatgctctccctaagcacatccgccgtcagaaacggcgccgtcggataaatacagcacactttttcaaatgtcactccacgcttttcatactcttcgagcacttccagaattacttcgtgcgttgccgcataatctccggccgcttcctttgaacggtaaaacgggactgctgcccctgcccgttttgcaatctcggcaatctcgctgtcatccgttgataccatcacttcgtcaaacacgccgctctttaatgccgcctctatcgaatactcgataataggtctcccgcagaactcctttatattcttgtgcggaatccgcttgcttcctccgcgcgccgtaatgaccgcaaccgcattttttcgctccatatcgcttttctcctcctcttatcttacatattttccgcgagccgtttccatacccgttcgtccaccacttcatatgccgctgcaaccgtttttattgcacagacggaataattcttcaggatgtagagaatgtccggttttccctgatccgcaccgaattccactctttttaatctgtatttcagatcatttatcttccggacgagctcctcacaggtctctcccgcctgccagaaccgcatctcgccctccgcccgttcgccgcgcgcaatgtccgccagtatctcgtattcgcgcagatgcagataaccccggttgttcgggtcggaaaagatttctatcagttctccctgatttccagcgttgaccagccgtttcagttcctctctcgaatcctctctgagtctgtcatattccctgcgccttgcacttacctcgcctgccacaaacggtttgatgtcctgatactccccgaccgctctttcacagtatttgtaataattcagcattttgctgtatgtattgtcatgataacaccacggactatcctggtacggcactaccacacggtagccggcccgccgcatctcaaagcactccgaaatatcgtaaaagtcccatccatcaaacagatcctcccgccagcgcacatcatgctgtgttgcgagcaacagtccgtccactgcctccacgtcaaccggctgcctgtctacacgctgtgtgtactgcaccctggccgggatacagttatggtagacacatccgacgttccatgccgcaaccgcctgtgcattgatcgggacatcatcacatccaaccattccgatcaccccgatcctgtcatcgctccgaaaaacggagagcatgtcctgaaggaactccctgttgatgatgaatgtatcctgatgcatatagatcttatatctggcatctgtatgttccatcgccatctggtagccggctgccatagacggtgcttcccgcactgcaatcacatccagttcatatccgtccggcacatgcagacggtcaatataagaaagcgcctgtgcatactcttcctcattgttcacacaggtaatcaccgctattttcataatcgttgccatcctccctgtttttttatataatcttatcagacaagtctcggaaaggaagtacatgcaatgcatatcctctactacagttggcaagaaaatacgacgtcagattttttattctccatgcaggcgctgggacatcaggtctccccctgtatgcatgagctttcctattacttttccggcggcgtcaagtccgacatccgggaccagctgcaggcgcagacctatgatgcagtctttacctttaactttttcccgctgatttccgatatggcggagtcccttcacataccatatatctgctgggtttttgactgtcctcactatacgctttattctaacagtatgcgcaactcctgtaactatctttttctgtttgaccgggatatgtgccagtcagtcatccggcgcggtgccagacacgcattccatcttccgcttgctgtcaacacagcacggcttaaggaacagcttggcatttcatccgaaggcggtctgctccgtcccgatacttacatgcacgatatttcatttgtcggctctctctatgagagttcccattacagttccttccgctacgcgccgaaccatctgcgcggctatctggcaggcatcattgctgcccagaaggaagtgtggggaatcgacctcatctcgccggttcttactcccggaaggctcgcggaattcaccgctttcatgccttattccggtgcggaatatgaaatgctgactgcaaaggaagttttttgcagcatcattcaaaaggaagtcacctcacaggaacggatcgaagccgtaaaccgtctggcggcttcccattctgtcgccctctacaccggttccgacaccgcatgctgtccggatgttctctcaaagggaacggtatcctacaccgcggaaatgccggatgttttctaccgttcgaagatcaacttaaacctcacgctgcgctccatcacttccggcattccgctccgcgcacttgatattttaggctgcggcggttttcttctctccaactatcagccggaattatgcgaatatttcactccggatgtcgattttgtctactttaacgatatggatgatctggagcaaaaggtctgctactacctggcgcatgaggaagaacgctgtgccattgccgcacatggatacgggcgggcctgtgatcttttctcctatcacacccagctgacccatatgctgaccgtctttgccgcagaatccaaagactgctgattaccggttgtcgagcagttccaggaactgctccgcccgcttatcccaggtatgttccctccgcgtcttctctctgccgctctctgccatccggcatctcttttcttcatccccaagcacgttctttatttttcccggcagttcttccagatattccaggtcgaaaataatcatatcattctcatcatacctgccgggaagatacccggtgttatccgtaaccagcacggctcccgccatcataattcccgccatccgttccgtaaagccgctcttgtgccaggacatcacatttaaggacattctggactgtctccacacatgaagtccctcctccacggtgactcccgggtggcagatcagattgggatatttccgaagcgggcagtgcgtccagctgtcgccaaacacatccagccggattccggcctgtaagatcgtctcgatcacacggtgcctgtaatagtgcatcgcgccgtaaatcacccgtctgaccgcatacattttttccacaaattcctcatccgtcagctctatcccgtagtgctccagcgttctggaaaacgccgcctccgcggtcaggttgggatatttccgcatgacaagcaggaaacggttcgccaggaagcgcaacggacgttcctgttcccggatccattgcagctgcatctcatacccgccataggtgccgacgaatgtcaggtcatagatccgctctatgaaatcctcccccgtctccattcctgccggcgggaaaagaatcgcatcctgtttgtagaagcgccggaagaaatcggcatatgtctgatccagtaccagcacatgaaaatccggataatgatgttcaaagtgcggctttccccagatcggatgatccaggaaaaaattgtacttcggaccgtatatgtattcgtgcagatagtggacctcgtcctccatcttaatcgagaacgcacaggactgtaccccgatcaccgccttaaaatgccttcccttaaactggataatttcacgcggatcgtgttcttcctgatcgaaataaagaacccgctctcccctgcgttcaagagccgctccgagctgttccgcaaagatcgtgagtatgttataacataccgggtctcccttgtagatcagaatcggctgtgctgcctcatcgatccggtaatattcctccttatgcccgatcatcccttccagataggaaaccgtctcttcatagcgcccttccatctgtgcctccgcgagcaccgcctcgatggcagcattaaaatagccggcttcctgcagctgtgcgctgtactttcccagaacgtagcagtccgtccgccagcccagaccggtattctccggcttctctacatcgtcgaacacaatcctattctcctgtccgcacgcgtcctcgtctctctcctcaagctcaaccggcgtctctgcggcgatccgcagcagcagctcatatttctgctttgccccgagtcttttattcaccccgcctgccagacgaaccatctcacgcggaaccgccacggttccggcacagattgtttcgtcaagcagaagatccataaaccagttactgttttgtgatttttttactgtttttatcattctcaaatcctcataaagtctactttattatatcggtatctgcgatccatttattaactttccctccgtctaaaccgatataaccttaagatattataacctcagaaaaggatattttttatgaatcatacgcctatcaatctggtcatcgctatcaaccggctttatgtaaagtacgcctatgtgatgctgtactcttttttatgccatcacccggaacctgtatcggtctatattctgcatcatgagcttacccccgaggatgaagccaccctgcagacattaagtcagcagtttgccgtgcatatatccctggtgtatgttccggattccctgcttcctccacccgaagttcttaaaaccagcagctgggggatcgaagcctacttccggcttgcgatcacagatcttcttcccgcttcggtcgaccgtgcgctttacctggataccgacattattgtaaatgcgccggtctatgatctgtatgagttggattttggttcaaagcttatcgctgcctgcaaagaatttacctgccatcccccgttcggaaattaccgggatgttttatttgcaccgctctttgaacacggtttttcctatttcaactccggcatgattctttacaatctcgccgccctccgcccggactattccttccagacctatatggatacggcaaggaaactgcattatgcgatcgaatatccggatcaggatctcttaaattactgtcattaccaggacacactttttgtcgatccctttctgtacaatctgaatgcgcgatacggatatgacgactataatatccattacgacgaattaaagcagcggggtgtcatcattcactatgcgtcctccaagccatggcgcggcaacttcctacactatgacatcgaatggctctggtgggaatacgcaaaacacacgccgttttaccgccagttattggaggaggccctgcgcgaaaatattatggactccccgctcaatccgtacattgcggatctggcgcaaaaaaacgccgcactctaccagaaacttgaaacctacgaacagcttttagaaacgcacggaggaaccatttcatgaagcccgaaccaatgaacattgcggtatctgtcagcaaatactatctgccatacacctatgtcatgcttcattcccttctgaaaaataatgcatgtcccattgacgtctatgtcctgcatcgggaactgtgccctgccgattttgattttttgcgcacactgacccacacgcatccgcttgtcataaacgactgccggctatcggaggatcagattccgctttccgcagatgacaacgctgcaccggcagccccagagagtctcttttatctgtctattccccggattctcccggcagatttgccgcgcatcctctatctggattccgacgtcattgtcaatgcccccctgtccgcgctgtatgcagccgacctgacgcatcatatgctcgctgcctgccagacagcgtccggcattgcagacggggtactgcttttcaatctggattgtgacgcatcctgggagccatttttcctgcaaaaagaactttccgctgttcttccgcttgatcccaaagtctacaacctgcccgcacggacagcgtataccgcacacaatctgcactatgagaccgtccgcacgcaggctgccatcgttcatttctgcggctccaagccgtgggagggcaactgttttcactgcgacatcgaacagctctggtgggattatgcgaaagacgttcccttttatgaagatctgatggaacacaccctgcatgagattgtgacagatccgacagttatcaattatatcagcaatctccggctggagcataagcagctgctcgacattatcgaaaaatacgagatcattttagaaagaacgagctgtcgcgataagcatagcccccttttgggtgataagtaatactataagaagaccacatcgtgggatttcagatggaaatgcagatggaaattcgttggagaaaaatgtgagcatttcttccggctgaatgtctgcatcggattccgtgtctcttccacgtttggacaatccgacgggtgcatgtccgacacaccggagacaatgggcggactttctggtgtccctaatggcacctcttcacagacaatataaaaccgcgcgaaccgaaactcgcgggcatctgctattgaaaataaggcagatgccgactcagacatcggcttcgcgcggttatgttttgctcagaggtgccataagggacacgcacaaaagtcctacaaattgtcttccgggatgcggacatgacccgcggagtgctccaaacttggaaagacacggatcatcgaagatgcagacatccggtcggttagaaatgccatattttttgatccgaatttccagttgcatttccacatgaaatccccaagtgtgtttcttatagtattacttatcaaagcaaggtatgcttagcacgacacaccatcttttatcttctcctccagcttttcaatcgcttccccaaagctttttctgctgtcgagcagttccttcgcacgctccctggcgcgggcggactgccggccgtaatatccggcatcatccatgtagcgcaggatctcccgctccatctgttcataatcacgcacgcgaaacgcctcgccggctgcagccgagacatctccttcgggcagcgtcaccgccggcagtccctgatacagcgcctccgccacagagcttccgccgcctgcacgtctgggattcacatagagatctccgcacgcgaaaacggcgagcgcatcctcctgtttcccgagataccgcgtatgcttccacagtctctcatagcccgtctgtatgctttgccaggactcatagcgtcccataaagactacctgcacattctctctttgtgcggcaatccgatccagcatcgccagaaaatcatcggcaatttccgaatccagccgccatcccacgatcatcaggacaaatccgtgttcccagatccccagctcctgtctggtatagtggtgttcctgcggcttaaatacaaatgtaaatctggcagcagctattttttccgcatccactcccaggcgttccagcacaggcagatctcctgttcccggctttccgtccagcaactggtattccccacaggacatcgccaccgccgaaaaaaccgtccccaccgtaatctccggcacgaacataccgcaaatatccgcacagatgtcgcttcctccgatatcgagcagataacagggcttccgctcccgaatcatctgcaccagctgtaccatcgtatccagattcggcatatcattcgcacattgatgaaactcgaacacttctccctgaaactcgatgtgatcaaagctgcacaattccggcagatagcccgcctcacagagatcgtagaacggccccgcaccttttccggaaatctgcatcgccgtgttgatgatcacgaccttcttcctcaggtacttctttagcaccaggcaacggtcgagcaatgtctttgtcggcgcatggttctggccgagcacctgtgaggtcatcacaaagaccagattcccgtctctctcctctaccggaacatagttccgtcccttgattcccagcgccccgcagaaagcatcaaacagcatccggtacagcgccgcgagctgttcctgtgtccgctcccctttgagccgcgcatcggcaaacacagccgtaccaatctgccagtaatcgctgagcttctcatattcccccacttcattccagtctgcatccagcactgtttgcagcagctcctgcgtataagccggcgtctttgacactttcatacaaaaagaaagcagatgtatccgcatccagacaggtgcttctcctgcctggtgctccatctgctccaatatcatgctgcgctgcgattcctccagcgttcccagtattttctccaaattatgaagccgttcttctatctgtccataacattcaaaatattcctgcctgctataacggcagatttgtccgatgaatgttccgagttccatattcgctccttattttggcgcacccgcaaaaccattatttgattcgtaccggtatgccccgctctcccagatattcctttgcctccctgggtgtctgttccgtaaaatgatagatgctcgccgctgcaaccgccgatgctccgccctgcgtaattgcctggtacatatcttcgtaactgccggcaccgccggatgcaatcaccggaacattcactaactctgtcgcgatctttatcatctctacatcgtagccctgcatggttccatccagttccaccgaggtcagcagaatctcaccggcaccggcttccacgactttctggacccattcttccagcgaatatcccgtgtcaacttcgccgttatgcgaaaaacagcggtaggaaccgtcgatcttcctgcagtctatgcttgccacaatgcactgtgatccgaataatctggcgccttccgttatcagttccagattgtcgtacgctgcactgttgatcgcaactttatccgcaccggcccggaggagctgccggatctgctctatattacagattccgccgcccacgcagaacggcacaaaacactctctcgaaaaatcacggatggactcgtaatccggatcgcgcccctctttggttgcctcaatatccaccaaaatgagctcgtccacctcgcgcatgttgtatactttaatcgccggcaataccgtatccactcttctccaggagttaaatcccacacccttcaccaggcctactgatttgtacagcaaggtaggaatcacgcgaacttttaacatctctctatctctgctccctttctctcttccgtcacatcgccagaaaattcttaatcaggcgaaaaccggctttctggctcttctccggatgaaactgcgtaccgacaatatgatcttttgccactgccgagacaaactcaccgcagtacggagtaaccgcggcaatattctcctcatccctcactttaaaatgatagctgtgcacaaagtagtagttcgttccatcttcaattccatcaaagagaggcgtttccacgcgcttttcaatgtcgttccatccgacatgcgggattctttccttcgcctgtgtctgttcaaaacgcacgatctcgcccggaatatatcccagtccctcgcactcgcagacctcatagccccgctctgccagcagctgcatcccaagacagattccaagaatcggtgtctctttttcaagcacggcgcggtttaattcctcaatccatccgccgtctcttagattattcattgcatccgggaaagcgccgaccccgggaagcacaatatgctctgcctccctaaggtcgagcggattatcgatgattaccgcatccgatccgcatttttcaaacgctctctgtacggaaagcagattgcccattccataatctataatgactgtttccattatttgttgtctttctcttctacattgtcatagtttatcttggtcagattaccgtttttatccttgatcagcttaccattcttgtccgtcaggaaaagcttcttgttcgtaaactcatcgcagatcttgataaactcgtctaccgtaataccgatcggctcgaggatatcctccagctttttgtccaggtaagtccagcggaatgcgccgtcgcgctcctttaccacctgcattgcctcctcacgggagatgcgtcccctgcggatatgcatggatgcctgatccgagcagcgtccgaatccgaacttcaggtacttgaagtattcatggattcccgcctgatagttatcgagattctcatagtcgtcataatcgccctcgaccactttgccccagctcttaaatccgtgcgcctttgcaaccagaacattgtggaggccttcccacggaatgtagtatcccaggaagattcccgtcacgccgacgcgcttcaactcttcatccgtcggatacgtaaacggaatcagatcctttttcgttatgccttcctgaccgatcaggtcattcacgcggagaccgagcataccgccgaactcttccagccatctgcggtccagcacgttattttcaactgctgccgccggtccgccatactcgttctgcgaattctctccccagataatcagcgggacgttaaagttcaccgccatacgcaccggtaccgtgaaaatgctgacatgctccggccaggaaatgtctcctacctctgtcagtccgatgcggttgagcttcgcacgtaccacacggttggtcgtcacttcgatgtaatccacacccatctttttgatattctcgatgttctctcttccgatcggtgtaagatcgcaggttgtcgcggtcacgcagagcgggttcatgcccagctccagcatggtaattacctgataggtactgtcttttccgccactgaccggaataatgcagtcccagtttgagtgatccttggaacgatagcggtccagaatctccatcagctctgcttttctctcatcccagtctacggatttgcggttctcataattcctgcaggcattacagattccctcttcatcaaaagaaagatgaggtttggtacttggcaggcaacatctcttgcaatatttaatcatgattgatttcctccattagtgttctttcacagtcttaagcatttcctgaatctgttctaccgacagccattccgtgttggttcccgagctgtactcaaagccctgctccacacgcttgccgcctgcctggatcttggaatcatcccaccactcgaagtgcggatatacaatgaaatgcttctcatattcgtaggtcatcatggagtcctcacgcgtaaccatgatctcatgaagcttctctccctcacggatgccgacctccggcatctcacatcccggcaggatcgcctgcgcgagatctgtgatcttaaaggaaggaatcttggaaataaacgtctcaccgcccttggcttccgacagtgccttaataacaagctgcacgccttcatccaggctgatccagaaacgtgtcatccgataatcggtaatcggaagcgccttctccccgttctctaccagattacggaagaacggaataaccgatccgcggcttcccgcaacattgccgtaacgcacgatggaaaagcagacatttttggctcccgcatatgcattcgcggcaataaagagcttgtccgatacaagctttgtaccgccatagaggttgatcggatttaccgccttatctgtggacagggcaaccacgcgctttacgccgcagtctaatgctgcatcgacgatattcatcgctccgttaatgttggtcttcactgcctccatcgggttatattcgcacgccggaacctgctttaatgctgcagcatgaacgacataatccactccgtcaaacgcacggtacagacgctccctgtctctgacatctccgataaagaaccggagcttatcgccgtactttttaaatttgttgctcatgataaactgcttatattcatctctggaataaataataatcttcttcacatcataatgatccagcacatactgcgtaaacgcatttccgaaggatcccgttccgcctgtaaccaatattgtctttccgtttaacatatgtaagcctcctactttcccgcaacatcctgttgccatatcatagtttatatcgaactttttgtccgttctcataacctctattcatactgaaaatcgccgccgtcttccatccattttacgatctgctccccgcggtgctgccaggtatgatgtgccagcgctttctgataccccgcttcggcaatttccgccgcccgttcctcatgctccagaagatctttgatttgaagcggaagctcctccagtctgttcagcgggaaggtcacaatctccttttcaggtaccagtaatttgctcaacagcgtgtactcgtttgtcacacacacggctcccgcaagcatcgccgtaaaaatgcgctcatgcatgccgtccagtatgttcgtattgttgatcacaatgcgcgagcgctgcatcagctttatcacttctgtgatatcgacgccctctgaggaaagtatttccagattttccctgcccgcgccgtcataggcatcccatccagcaccgaccaccgcgactttcagaccgtttgtcaggagtgtctctatgatgctctggcgcatatagtctctctggtactggtccagcggttcgagcactttctgcatcgcaaaaaactcatcctcactgtattcaaatccgatctcccggagatagttccgcacttcctctgtccaggagctcgccagatgctctcccacaatgcggggcattacctgttttgctatggttccgaacacgcccggtatcgcgtcaatcctgctctcggaatcccgcagcggtttgtacgttcccggaaaaaacaaggcaatgtccttcttgtggtacggtacccggccctccggcagaaatccgccatgatacagcgtctccacccgctcgaactttgaaaattcctcccgcagctgcgccgcgtgcgaatcgcgcaccatcagaagacgggcgtttgttcccaggcttccccagattcttttctggtggtacaccggatcgtccacaatccagccgacacgcttcatctccgcaagttccggcagattttcgctttccagattccacaggatcgcctgtatggaaaaataaaatgcatactgatcccggtgttccagacattctataaacctgtcatccgctccgggttctgtcgccccgatcatatctacctgatatccgcatttgcggaatccctcacagatttcatccgccgctcttcccagtacgtcatacgctgaaatccctcttatcaccagtatctttttcatgagccgtctcctcatttcttatccccgctgacccttgtcagtgtgcatgtaattattatataataatcatatatggaattcaatttttttgatgattgaggaacgatctatgaatatattgtgttaccgctacggcagcattgtagaaccggatataatcgacggctttaaagaacttgggaatcaggtctctgagatatgtcttgaaatctacaacaaaaacacaactccgctcgaaggactgaccgcactgaaggacgagctgatgcgtcacagttacgacttcgtgttcagcatcaatttttacccttttattgcagaagtatgtaatatctttcagatccgctacctgtgtctgacggtggacgctccggtgctggagcttttttccaattcgatccggcttccgtggaaccgcatttttctatttgaccgcgcgcagtacgaggattttcatccacagaacccggaatgtatctttcatcttccgttagccggcaatcctgcccgctacgcacccgtcatcaggaacgccacccccgatctgatccggaaatattccgccgatatttcgttcgtcggctcattatacaccgagaaatgtccttacgaccggcttcagaccgaagatgcgtatctgaagggctatctggaaggtattatggatgcacagatgcaattacccggctgctatcttctcgaagaactgctgccggacatcatcgttgattctttccgcgatgccatgccgcaattctacattccgcctgagaattccaggcgcgatgaccgtgctgtggctgcgcagtactatttgtgtcccaagatctcttccacagagcgcatctctatcatgcgctcgcttggcagccgctacccggtatgcctttacacgggaagcgacaccaccgggcttccggtcagaaactgcggacgcgtaaagacgcacacccagatgcctcttgtatttgcgaacagtaaaatcaacctcaacattacctcccgttccatccggactgggcttccgctccgcattttcgatgttctcgcatgcggagggttcctgctcacgaatgcacagagtgaactgccggactgtttttcgatcggcgaggatctcgactgcttctcttgtgaggatgatctgcttgccaaggtggaatattacctgtcccatgacaaggaccgtgcagagattgcacacaatggttttgaaaaagttcaaaaataccacacttacccggaacggctgttgcagatgattgcactggcttacggtctttcctagacggaggattttatgcgaattttatttttagactcaccggcttttgccaaacaggatatgatagacgcctttaccgcctgcggcattacctgcgacctcttttttcatgaggcgtacaacgacaggcagaatgtttcttacgaggagaagtttgacgccgccgtttcccgtttttcctacgattttgttttttcctttaattattttccaattttgtcaaactgttgcatgaagcatcatctgaaatacatttcgtacgtatacgacagccccttggtcacgctgtactcctacacgctgatcaattcctgcaattatgtatttctttttgacaaggcgacctatctggaattccataacgcaggaatcccaaccgtatattatcttccgctcgcggcaaacgtatcccgcctttctgccatgaagtgcccggacgcactgcttccgcaggtatcctccgacgtttcatttgtgggatcgctatacaacgaggagcataatctttttgaacggctgaacggtctatccgactataccaggggctacctcgattccattatgctcgcacagcagaacgtctacggctacttttttcttgaggatctgctcacgccgcctatccttgaggatctacaggccgcatgcccgtaccagccgcttccggacggcacggaatccgctgcatttgtatatgccaactacttcctgtgcaggaaaattacatccaacgagcgcctgtcactgctgcgccttgcctccgaccgctttccactcaaattgtatacacaccatcccagtcctctgctcccaaaggcggagtacatcggtcccgttgactattacgacacgatgccctacatttttcaacacagccgcatcaacctgaacatcacgttaaagagtattcattccggcattccgctccgctgcatggacatcatgggcagcggcggtttcctgctgacgaactatcaggaagatttcctggatgattttcagccgggcgaagatctcgtattttatgagagcgaagatgattttcttggcaaaatcacttactacctctcacatgatgctgagagaagacagatcgcggcaaactgccttgggaaaatgtcggaatcccacacgtttgtccaccgcgtcaacgctatgttgaatgttatctaaaaagaccgccgcataaaacggacagtcgctttgacgcgctaagtaatatgaggagaagaacatgcccttcgatttcagatggaatgcatctggaaattcggatcaaaaaatacggcatttctaacccgacgggttttgcatctgcgatgatccgtgtttttccaagttttgagcactccacgggtgtgtccgcaatccgcagacaattttaggattctcgtgtgtcccttgcggcactgatgaacaaaacataaccgcgcgaagccgctgtctgagccgtcatctgccctgttttcaatagctgatgacggcgagttcggttcgcgcggttttatattgtctgtgaagcagtgccgctagggacactagggaatctgctcattgtctgcggtttgtcggacacattccgtggattgtcaaaacgtggaagagacacggaatccgatgcaaaagcccgtcgggaagaaatgcacgcatttttttcaatgaatattccatctgcatttccatctgaaatcggtgggatgtgtttcttatcatattacttagcacctcaaatcaacctcccgttttatgcggcagtctttttaggcatacatttcaatgtcttccgtcagaagcgatacggctctctcatatccctgataaagggtataattcttctctacaagttcctcgattcccatctcttctttttgatagatttcatctcccagcgcatattcttctgtctgcgcataagacaccatcataccaaacagcggaagctgttccagttcttcgttgtgatccatcatacgcttcaggtctggcatcagttccgccacagaccgctgctggcgcagttcctgcagcagcttctcctgtatcgcaagtccctgctttacctgcgtgccaatgctgtcaatctgctggcgcatcttatgccattccgctgccagctttgtcttcgtctccgccgaatatgcatccggaatgttcttctcaatctcctcgaacggaagcggtctactgcaatattccgcgacgacatctttcaatgtcataagccgggttccctcgatgcgtgcgcctccctctgtcgcatcgataacctcaatcagcccctcgttcgcacggatcgccttctcaaaccattttttgtagtaccacatctggaaatccgtctctaacatggttccgtcaattccctcgacctggatccggtttcggctctttatatattcgtcattgtcgccgaacgccccttcaattcccgccgtatgtgagattccgccggtaaacgccatgtcctggccgatcaggatcagcttgcggaagcccagatagcatgcaagcgcaaacgccgtcgcagaaacgcagccgccggacggaatatccggaaacgggtactccatgttctcatccaggatctgattccagcgcttttcaaaaaagccataatagtacacccgcttcgcacagtgttccaatacccacggacgggtaatgcggttgcagcaccatgccagatccgtcacatccagattttcaaagaaacggtccggggattccgggtcaatcgtacacaccatgtccggtcttacgcccgcccgcagcaccgtgcgcagcgcggcgtcaaccaccacaataaatgcctttccctgtgcttttttcaattctgaaatatttttatccagggacggtccggcggacaccagaatcgccggtatctcctcgacgtttaatccctcaagtgcctgcctgatctggtaaatatttctgcatccgatcatatgtttcatattgtacagcgtatgctgcggcaccatgcgttgaaaggtcagccgcgtgctcttgtgtacaatctcttcctgcagacgttcctgtatcgcatccatgaattcctcgcacgcatcatggtacaagacatcatatcccggcagaatacaaaattccataatcataaaattcagatcctgcagcgtaaatctcataatggtttctatatccgccgtcaccccgggaacgcagatctgcagtctgtcatccgcaataagatccgacaaatccatgacacagttcaccagataaaaaaaggaagcgtttggctcatacacgatgacatgattggtgtcgtcacactgcccaagcagttcccggatgtgtcgtccatccgacaatccaaacacaaaataggtctcgtaaatccgcggcggataccgctttgcatagcagcttgccgctgcttccggatccagtctgctgtttaaataccagaccctgttcgtcgtctgaattccaaagatcttctcctgcttctctgtctctgccgttatgatattgttatctatcgttatagaataaagctgttccagaagcgctttatttctctgtttccatgctttttcattcttatcgagcaatgtcatctgttcgttccccttatttctccggactctgattctcttctgcttccaggcaaaggatcatttcctctgccaatcccttcaggcagtccgccatccccagcatatcctgagcctgatagttctcgattaaagtttttaacacttccagaaattcgagcgcacgcgcactgtctgcccctgcatagattgcctgtatcatttcctgaaactgcggcaataaattgcggactgcttccaatccatcctgccccctgttctggtacaggcactcggttgcatgttctatgtctgttcttaattttacagtatccatcgattatgttcctctatcttactcattcgctatctgacctttaagctgaaaaaagccggcagtaaactgccggcttttaaatttactacaataatgattactgtaataaggataatacaccctgagtagactggttagcctgagcaagcatagactgtcctgcctgagcaaggatgttgttcttgctgtactcaaccatctcttcagccatatctgtatcacggatacgagactctgcagaagatgtgttctcagaaatgttgtccaggttggagattgtgtgctcaagtctgttctgtaatgcacccagcttagaacgcatagaagatacgtagctgatagcatcctgagctgcagacattgccttaccagctgcagagaaggaagatactactaatccgctaacgccaagacctgtagcagacatatcagagatatcgattgtgatagcctgtccgcaaagggaacctacctgaagcttcttacttgtgaagttaccatcgatcaggttcattgtgttgaactgagttgtagaagcgattctggtgatctcagatgctaactggttgatctcctgctgaactgcagttctgtctgaggttgtattggtatcgtttgctgcctgagttgctaactcattcatacgctgtaagatggagtgtgtctcacttaatgcaccctcagctacctgaataagggatacaccatcctgtgcgttgtcagaagctttatttaagcctctaacctggcttctcatcttctcggaaatcgtaagacctgctgcgtcatctgctgcgcggttgatcttgtaaccagaagataacttctcagaagacttagcctgtgcgcctgttgtgatacctaactgtctgttagcgttcattgctgtaagattgtgctgtactaccataattgtttcctccttgaatatgatgcagcatccatgctgcatgtgctttgtaatgtggtttctgcctctcccggccgtacgctccgcttaagcttccacctcaagtaacaattgttatcttgtttacttgtaatatatatcggacgaaagtcacgatactttatagaaaaaagaaaaatctttttactatctgcaattattttttattatccgtaaactgcggctccatatagccggacttcatcatgctcttgtaatactgattgacgaccttctgactcttgcgcacttccttgacctgtttgcgcacagaggcaaacttctgcgtcatcagatctttgttgcgcgcctcctgcgcctgaatcgttgcgctcttatcagtcagcctgcggatgtattcctgcatttccgcaatctcttcgcggtattcctgctgattggtctgcagatctgcttttatcttatcgtaaacctcctggaatccggcgtcaagaagctccaactgttcgatctgctttgctttttcctccacgcaggcgtcaaagtcatccggatcaagacccggattctccagttcttccttctgtcgtatattcagttcaataatcgcatccagaaccgcactttttttcttcaggctctggatcatgattgtaagatatggattcttctccattcgctgctcctgtcaatctgctgtaaccgacacaccgttgcttctatcttgatgcatgtgccgttctcataacttccttccatgtatcacgcatggtacgaagatgctttagcacctcttccatgatgtctttatcttttttgatatttgcctcgcgaaggcgcatcaacagatagttgtagacctcgtcaaaatcctttgccaccggatatttatggtcaagtgtactctgaaactcctcaataatacgctgcaccttcataatattattgtgtgctttctgaatatcattcgcatcgatcccctcgatcgcaagattggcgaatttgattgccccctcataaagcatcaaagtaagttctgccggggaagcggtcataatcttgttattggcatatgctgcatatccctgatttgctaacataatggttgtcctccatacatatattcgtctctgccggtgcttttatgcactcagcagagacgctttcacggcattatgccgtctaatttccaaacagactcgacagtgaggatgtctggctgttcagcttggataatgctgtttccatcgcggaaaacttattgtaataataatcctctttgtcctgcagtttttcttcccatttcttgataagatcggtataatcgctgtattctgatgccatctccttgtcattatataccttgtaactgctgcttaaggtagatgacttcatcttctcgccgactgcatcatagagaccgcttgtcagctgctgcataaaggaaattaccgtatccggatcagaagtgatcatcgccatcagcttgtcggcatttccggacgtagcggtgtcatcctcgtccccgtcaatatggtatgcatattcctgattctccggcgcattgaagtagccgagagtcttaatgccaaagttggacagataataggtctttccgtttacctcatagcccttgctcattgaggatgtcatggcattcatgactttttccagactctcatcacggcgcagcagggaatccttgatcttctgctcccatttctccacctcggaatccgagagagcatctttctcatcatcagtcaacggctcataaccctttgcggaatccgcattgtagagtgatgtaatctcattgatcagcgcattgtactgtgtcaggaaatcctttactttatcgtaaattccctgtgtatctgtcgatgtggtaatagaaatcgcattcgtatctcccgcaccggttgcctgcaatgcagtgatcgacagaccgttgatggtatatgtattgagcgaactggtatatttgattccattcagaagaatctcggaatctgtaccatcgatcttcttagcatctgaattgtacgttatgttcgtgccgttctgaatctcatgggcactctgcacctggctcacaaagtctgcaaatgcggttgcatactctgcagatgtctcatccatcgccgcgagcttcgacaataccgcattcttatcaatggcatcctggtctgccttcatggctgtcttgttggcagtaatctgtgatgcgtaggtattggtaagcgtcgtcacccccgctgaaccactcgccgcataggcattctttaccgctgctgcaatgctcgctctggaagcactgtcagcgctgtctaacgtatcctccgcattttcaaacgcattgactttctcaacatttgaggtcatcttgttgacaaaatcatctgtcagggtgtccttgtttgcttcttttaaatctgtaagcgcatctgcggcacggccgatatctgttgctgcggctttctgatgatacaccatcttctggatttcactctgtgtgcaggcagaaagtgcaactgtcttgccgtctgctacttcattaccgtcactgtcgatctgtaccagattgccactgctgattttgtatgtattcccgtcagaacctgccagagtattgttgtcattctgtgtgtaggtcacaccattgctgtctgtatacttgtaataaccggttccacgcgattctgcggttacctcatagtaattggtgttctccttgatcgtggcagtgttcaccgtaccgtcatccgccgtatatgaatacgtggcattgccgtctgtgtccttcccgccggtcgctgtccatacatgaccgtcaccgtctgtgtaagtaccgtcgtcattcttggtgtaaacgttgttgctgccatcttcataggtaaccatcttgcggatataagtcgtatcaccgttctcatccttatagctgtaaatggtattaccaagactgtccgtatcggacttcgtgtagacatttccgtttgcatccatcagggaatccactcgctgggatgccgtcattccaagcagtgtctgcagcttcttctgatctgcatcggaaagtccgctgctctttaaggcatccatcattgccgaataagcgctggcataaccataggatgcggtcagattggcattctgtgccgactttgtcttgtaatcctcctgcgccgccttgtaagctgcgatcgcatccgtgatattctggttaagtttattgccatctgcatcataatactgtgtataagacgtataggtggcatcggttgccttggactgtacattcagccccagctttgtcaatgcactgataccatctgcatcgccgcctgtaagtgtaaaatcattatcctttccggtgctcttggagctgataaagaaacgatggttcgtctcatcgtaattcgcactgacgcctgcgtccttcaatgatgcaaggaagcccgcaaccgtcgtcccctgtgttaccgtaatggaagtcgtcgttccgtctcccatcgtcagattgatcttaccgtccccaccggtatagccaagctccgccagcgtcgtgcctgtggacacgctgctatccagctggccgccggtcagatatcccgcctgcgccacactgataacattcagggtctgtgtaccgctcggcgcagtattgcttgctgtcactgtagctttggtggtatcggacaccgtggtggatttcagattgtatgcgctggataatctgagattacccacgctggaatacaagctgtaaatcttggtattgagcgtcttccaggcatcctgcttccaggaaagcttggtctgcgcttttttgtacttgttggtcttatagttatacgacgataccagagccgagatgatcgcctctgtgtccagtcctgaatttaatccagtaatacgaattggcatatgctcaccgttcctttctataacttctcatccacaaggattcccgcaatctcccataccttggcgatcatgtccagtgtctcctccggcggatactccttgatgacttcctttgtggtcttgtcgatgatcttgattgtaacacggttcgtcttgtcgtgaattccgaagatcgcctccgagttcttcatctgtttgttcagatcattgaccgctttttttaactgtgttccctgctttgcatctttttcctgggacggatccttatcctcctgatccttctctgtaaaaaagttctgcaccgcgggcttcttatctgctgtctgcgacagccctgcctgtgtggatgcttccggctgtaccgcagtatccggcgtttttgtggatgtcgctgccgcacttccctgatacgacgctgccgctccgctcttcatactctctatttccatctcttaccacctccgtgtgatacatggctcctctatgttcccggttttctatgtcttatatcggagaaactatggcttttattaaccgcatcagaaaagattcttcaacgcctccattgcatctgttgcgttcaatgccgccttgttctcattctgaatctggaggtaaacctccttacggtataccggcacttccttcggtgcactgattccgatcttgacctgatctccgcggatctctaacaccgtgatctcaatattattgttgatgaccagtgactccccttttttgcgtgtcaatgccagcatgccttattcctccgctttcttctttccttttactacgtcatagatcttatatttgacaggatagtcatcttccacaatgatctgtgctcccctgcgggtgtctgtgttaatgacaatcggcgccttgaggttcaccgaggtatccttcggatccggcgctgccgtaagtgtgacgagcacgtaagtattgtcctctgtcatcccgccgagcggacgaagcatctcatcgttcaccatcggattgtaatccgggcgcacgaggtttggctgcatgaccggaaacgccgtgtgcggatcgtccatggactggaaccacatcacggaactcttgtctttttccttttcctcatcaaatatcaatgcaaaattccggtattccggaagtccgatcattccatcctccaatgtaatgatcttatcatccgcaatatcgatttccccaaaaagtcttgtgtttgctttcatcggttctcctccagcttccccgtttggtgtctgttaaatataattcaataatgttgtctgattgatcttcgccgcagcctgtaaggatgcctgatatgcagtgtacgccgacgcatagtcaataatgatctcggacagatcccggtcttcgttggtggactttaattcctccatcgtggtctgctgatttgccatacggttcttggtcagatccaggctctgccccttgcttccgaggtccgtgttcgccagattaaccttctgcagataatcgtcaaaattaccgatgtagctgttataaagcttctgcagattatcgtccgcgtaatcgcgttctttcttcgccgctgcgatccagtcctcaagtgccgcctgacagtcatcggaagaatactcctgcattttctgcattttctccagttcctcgactttattgtttgcgtcctgtgcgaactttaccgcctcgatcatggcgtcaacgtctcttccaatcgatgcatcaaatacagcggatgcctgtgtattgaccgtcagggtctggtttgccgctacgacatagttgatatcctgatagatttccttgccgttttcaaactttatatattccaccggatttgccgcatctgtgatgttggtgcagttgtaataatactccgggcgtacctcgcctttgttaaatccggtcttggtgtagttgacatccaggcttgccttgccgctcttgatcgttgatgacgcatcagagcttaagatcagctcaccgctctccttaataaataccgcttcaccgtctgtgatattgtaggtgttgtccgcagtctgggatgcttttgcccagtcctcaaacgtatcgtatacggttaccttcagttcgccgtccgtctgtgtcacaccggctgcatctgtgtaggaatagctgagcgttccggtcgcaccgtttgccgacagcgcattgccgtccttgtccgtgatgctgtcgatctcgccgtagcttaaacggatacggtcgaatgtcgcctgcttcggattcgagatggtgttgcctgtcacctccgccgctgtggtcgggagtgtcacctcatcgctgtagtagcggtgctcttccaggttcttataggaaagtccctgtgtgatattgtaagatgtcgtattgtcgtctgtcataaaggtcagcttctgattcgtgcggtaaccggtaaaaacggtacgtcccgcataatctgcatttccctccgcgtagacctgatcccgcagcttctctaactgggtcaagatcgtcttgcggtcatctgcggtaatctgatcggatgctccgtaagtacactgtgtacggatgtccgtcagaatcgtcttcatattggcaagtgccgtctctgtcactttcatccaggattctgcatccggaatattgttctcgtaatactggtcaatctcgctgagtgttgtgcggagtctgagtgaacgcaccgcaatgaccggattctcggaaggtctctgaatctttttctgggatgtcatctgattgttcagattgttgacattcactttatttccattgatattgcccgtcgtattgtgaagtataatgttattcgtaatacgcatttatgattcctcctcatgtccttgtctatacaccggtctcaaggatcagtctgtcataaatctctgccatgacagataccatctttgaagaaagattgtaggcattctggaatttgatcagatccattgcctcctcatcttcatcaacgcccgaaatcgacatacgctgcgtgtcaatcgcgctcgccacattctggtaattcttgctgaaaatttctgactgctgggtgtccacggaaatatctgcaatcatgcattttaagaatccgtccgccgtacctccgcggtaaagcaccttgccgctctttaacgtcgcaagttcctccacgagatcgtacgcatccacgccaccctttccgttgatgtcaacggttgtcgccagcttggtcggatccttgacaatcatactgttcacacagatatttgctgctgtcagcttgtaatacgtgtctgagccagatccgttgactgcattcccgttcgcatctttgccgtcgaaggaaaactcttcgccggtcacggtgtctgtaccggtgaaaaatgcatatccgctggtggaattgccgtccagatcgacaccttttttcaaaatattgttgaattccgtcgcaaagctgcgcaggaactggttcatctgactcatataatacggaatacccatcgcgtcaatcgacgttccgaccgatgccgtgcgtccgtctacacgtgcctgctcttccgccgtgagcgctctcttcatattaaaggtataggaagtgatgttgccgtccgcatcctgctcaaaggtaaatccctcatatgcgtactctctaccgttgatcgtcaatatgccttcctccggcatgctgactcccacaatactcgtgatggaaggattggtaatctgaacctcggtgctgtttaacacctttgccagtcctgagaaattctcgccgttatttccgtcgcggatgtcaaacagcgcttttaacgtgccggacatcgagcttccgcccgcattaaaggtattgcctgtcttcgaccatttaatatcataaagtccggctgcatccgtctggttgaccttatactctctcgccttgcactcgagcgtctcgtaattgtaggtatctacaagcacctgaccaccgatttttacagtgtagtaattggcacctgtcggctcgtccggatggttcgtatccgtgatcggcacctcggaaacctcggtcggcacaatctcggacaactcatcaatcaacagggctcgctggtcgcgcagctcgtttgcgtagccgccctgaatctcaatgacgttgatctgcttgttcaataccgctatcttctccgcgatcgcgttaatattctggaccgtggatttgatctcatcattcgtccccttctgaatatcggtcagtccttctgacacgctgttgaagtaggttgccagattctgtgcgcttccgataaactgctggcgggtattgacatccgatgcattgttcttcaatgtatccagtgaattgaacatcgtgttcaggatcgtcgtaaagcccttggatgagctgtcgtcgataaaatagttctcgatctgttgtaagtagctcaattttgtctcatacagtccgaccgatgactgattgtaccagtattttgtatcgtaatactgatttcggatctgcttgacagataaggtcgtaacgccgcttcccacagctccgtactgctggtgcactaaaagcgcatccgatgccacacggttcgactgctgtctggaatagccggttgtctgcacgtttgcaatattgttagccgttgtattcagtgcgacctgataggcacttaagcctgatgatgcaatatttaaaccaaaaaatgtagatggcatgtaacaccctctctttctattacgcgctcaattatccaagctgggtcagcagatgttcgatcatctcattgaccacattgatgaaacggctggctgcattgtaagcattctgatacttgatcatgtaggtcagctcctcatcggaagatacgccgatgacctgctgtctctgattgtccacagaagccaccgttcccgtgaggctggtcgccgtggaattgtagacatttccgtaggttgccatctcaccgatcatatctttgtagtaatccttaaagctgcaagctttggtgtcgttcgggttcagcgtaagccgctcctcatcccacacaccggccagctttgctgccagtgcataatcgacatcaccgttctggcatagatgcggcagcagcgtttcatcgatcacaagcgcctcgttgacacttaagctctgcagtgtgtactgctttgtggtatcgttcgggtcctcttcattgtaaatgtagatctccttggtctccgtcaccgggttgccgttggcgtccactttcggattgccgttctcatctaccggctgataggtgtaagtcgcctttgtgtaccgctctgttccgattctggagaacagttcctgcggcggaagctgcttgtcggaaccggtcgcgcagttgtctgcatccagaattttggtgttcgcatttaatgttacggtcgagccgtccgccagtatcacatccagcgttgtagcagcaccgttcgtaagattcttaatcgtatcttccgcagtcacattcggacaaagcacatcatttaacgcggtcacgatgccgtggatcatctgatccagctgtgcctctgcccgcagcatgacggacattccggtcgtatcgttataggtatcctgatccagtccttcaatatccgtatagttcgcgatatggtcgccgcgcgccagtaccagcgctttcagttcacccatatcgttcttgttctctgtggagatatcccggctgccaaaatcaaatacgttgacgtattttcccttgttcacatccgaaaggtagccccagtacggtgtgataaaaccggtcagcttgtctgttttcttctcgatatgatagcaacggctctcatcgataaactccgtgccctcaatgctgactttcacaataccatcggctgtctcgttgtaggaaatatccacgagggcggacagctcatccagcgcctggtctctcgcatcgcgcagggtcatggctgtctcgatgccgcccgcctctactttcatgatctgaaggttgagatcctggatggtatcgccgagcttgttgacctgatcgatattgtcgctgatctgcgtattgatgttgtactggtaactctgtaatcccgaataaaccgcattcgcgcggctcacgaacagctgtgccttctggacaaccagattctggctcacgctgtcatccggcgtcttgtacaattcctgaaaagaggtccagaaatcttccagtgcatcctggaaagcctgtccctccatctcctgaaaataagtctcgacctcgttggtcgcctcataagttgccgcatagaatgcctgccgtcccgactccgtgcggtaagagcgatccagaaatacgtctctggaatgaatcacatcaccgatgtaaacacccagaccggactgctgcttgctgactgccgtcgtctcattaaaggttacatagttgcggtcggtaaacagtacctgctgacgtacatatcccgtggtatctacgtttgcaaggttatttgccgttgtatttaatgcgttctggctgctctgcaagccggacacgccgataaacaatgttccaaaaccatttgccatggtatcttcctccgtgctgctctatctactgcttcgcgtcaaatccgctgccgccaagcaggtctcctgtattataggcgtttttattgtaattagcggtctccggcgcctgccgcatgctctttagcagcgtaaggtcaaattccaccatctccatcgcctgctttaaaagggcctcgttctgatggttcaatgtctgcatcttcgttcccacttctaaaagtctgtcccggcgctccgcaagcatctgctgctctctgggctggttctccagataaccgatcatacggttgatcgtcatctgctccggctttttcccgagaaccgtcgccatgtcattaagcacctgcgtgcgcttgttcgacaggtttaacagggtgctcgccgcctcctgctccttctccgtcacctcgccaagcttcgcaatgtccgctttgataatcgcctggctcttcacatccgcgagatcaatcagcgtcagatattccgtttcttctttttccagaactcccagaagttcttccattaaactagccacaatctgccctcatttctcttatcctacagcataaaggaacgatatttctccagaagcttctctgcaaaagcctcgttgctcacatcgtaagtgccggatttcacctttgcggagagcgccgccaccttgtcctctctgatgtcagaagtctcggctactgcctgctttgcgatctgataatcatatcctatggaagagatctcaacctgatcccggctcttctcagtctttgctgctgcggatgccccggctgctctgtttgtcttataaatctgtgccacgctgttatacgcttctactcgcataatggcatctcctttctattctgtaacgcaaaaataacttttctagtcaatatatcggatgatttggttttttccttagtgataatttttatgagataaaaagatttcgtcttattttcatcattgacggcaccaaaacaagggcattgatctgccctcagagtcattcttaaggcgcagatgcaatcccctgcaaaataatgtatatgaatccattcatttgaatacaagcacctgcttacccgcagataccattactgtgcaaaaacaatttcactgtgcatcagccaattcgctgtataaaaaccgtttcactgtgtatcagccaattcactgcgcaatggcaatcactgcaatacgagtgtcacggtcagtgttccgccattcgctgatgcctgaatcagcagcggctgtgaaaatgtattcgtaaacttcagatccagatagctgcctgcaatcgtcgcgtcaagtcccgccggaagatagtctaccggaagggaatgtgcatggcgctccgttgccggaagtcccgcatataccatcgccgcatacagtgtggacgatacctggcacacaccgccgccggtgccggtgccctttttgccgctcacatagatcggagccgtcacatatccgttcgcagatgtgcgcggtaagatggtattgctgaaagaaaagctgccgcccggctgtaccaccgtgccgttaatgcgctgtgccgcaagcgccacgtttgttgcgcgcggaatattgtcaacataagaagtcgtacaggtaccgatcaccgtgccggatgcctgctgcgtgctctgtgccggtgcactgctctgcgctgtcccattgttctgtgtcccagtctggctgtccgtctgctgcgcctggctgtctgcctgctgtactgccaccaccggctgtccgtccgcgctgccgtttctgccctcggcttttccatatgccacataatgtctgcagtaagccgccatgtcgctgccgaacgccgcctgcagatcctcataacgctgtctgtatgcctgcggattaaattccgcgctggcattgcggccttccttcacgccaaagctgatgaaatggttcagaagcgcatctgcattatttccataggctgccgccacatccggatacgccgcactgtaataggatgcgtcaaacaccgcacggtacgccgcgcgatccgcctgccctgcctgtgcctgtaccggatgcatcaccataagcatcacgccagacagcacacacaacattcctaataaccattcctttttcacagctctcataactcttcctccgaacgtaaccacagtttcctcacagaccgccttccttctgtctttctcctgtgtgcattctttccgtttcctgcggttctgtctttttttgcattgtaacagagggtttatcaaaaaacaagcaaagttttcagaaagtgtcagaaaaattgcatttgtatctattttccgcttttatcttcatcaagtggttctttttcttcctccatttgtgcaaatccaagcacaaccttaaagagatcgccgtccacatagagcataaagctgccgcccatcagttccatcaggctctttgcaatggagataccgagtccgcttccctcggtattgcgcgattcgtccccgcggacaaaacgctccataagttcctcactggatatgttgagcgggtagcgcgacgtattccggaaaatgagttccacctgcccgccattctcccgcagatccacgtatacccgcgtgcccggctgtgcatatttgcagatattgttcatcaggttgtcaatcacgcgccagaaatgtctgccgtccgccatcacatacaccggcgtctccggcttctggatcagcagcgtcagatctgcggcgttcagtttgtcctcgaattctccgacgatctgcaccacagagacgcccgcctcgagtttttccagatgcacggcgagattgcccgtggaagctttcgacgcctcgatcagatcctcaatcagctttttcagccggtttgactgacgctctaacacttccagatacccctctgccgtctcattggaaagctcctctttttccagaagatccacataattgatgatggaagtaagcggcgtcttaatatcgtgcgagacgttcgtgatgagttccgtcttaaaccgctcactcttcacgctctcggcaaccgcctttgccatacccgtctggatgctgttgaggtgctcgccgtgttcctttaaatcccggtacatgtgcgtcgtatcgaccgggtgctccatatcgccctccgcaaggcgttcgcctccctctgcgagacgcttcatctgtaaaactccccagaagatgcatgcaaactctacgacttttacaaaccgccagcccgctcccatgctgcttcctgtatgaagcgtgccggcaagcgcttccgccatcatggcaatgccaaaaacaagcaccgcccttaggaaaagaggcagattccgggtcaccgcgccgcaaagcctgccgatcacgccaagcgccatgtagacgacggtatttttccaccatgccccggctttcacgcgcgcagcaaaggtcagcagcgacagaagcgcaatccaccctcccgctatgaggcaaaacaaaaccccgacaagcatcggcactgcagcatttctgccgttgacagcttccatcaggatcagaaacagaaatccctccgccaccagcgcaaatccgagatacacatcaagcggcatgccatccagccaggtaagcgtaatcccgtcctctcccgcgtgatgccccgccgaccgcaccagccacaccaggcagaatacggcaagcacaaatgccgccgccagaatcgggaaaatggcatagcggacgccatacatcagcgccgtaagcgtcgtcacctgcacaaacaaatcgtcactccagccaagcggcacattctccggaagaatcgtgactacccagtatttccggtgcagtgattccgccgtgtagttcatctgcagcatgccgtcagtaagctggtacgttgtcctggcatcgcttcccttttgctccagatcagagttcccgattacagtgaccggtattcccacaagctcaccgcaggtgactccgtccagaatcacactgttcgtccagtcgaccgtctgaaatcccgtgttttcgctcagactgtctgcatcgtcgaatgtcacataggtcccgctgtacgcatggagatccagatattttcctacatctgcgtcatacgtgtaatcatagcctgtcgccagatccggcgacagcatcagaatgctcacatgttttaccgggatgtatgcgtccggcgtttcataataaaatatgccgtcatccgcattgtaacaccgcttctcaatctccacctgcgcagcgtaatctccgccatccgtgtagaggctgtacccgccccacagcgtcatgctgtaatcgtagcgtgtcacctcattgatgtcatagcttttgcagtacagcttatcccttgtgaccttctcatcaaaattgcgctccacataagtgtacgattcgttgagatctacggaatcaatattttccgcttcaatgattccatagcggaaatacgtgtcattccaccgattattttccggttttgcaccattttccatgttcacactgtaatccagcgaccggatggcatactgatctgcaacactctgataactctttgtaaggaactgctcgcgcgacatctcatacacgcccgcctgatccataagcaacacgccggcagcccctgtgaaaaataccaccgcaccgagcgtgatgccgacccacgctgccgcttttgctcccacactgtcttttctgtttctcacactgtttcctccattttatagccccgtccccacacgactttcaagtagcgcggctccgccgggttatactccaccttttcccgcaaatgccttatatgtaccgcgaccgtattctccgtgccgtagggattgtcccgccacacctgctcatagatctggttcggcgaaaatacttcccccgggtgttccatcaaaagttttaaaatatcgtattccgtgcgcgtgagcgataccggctccccgtcgagcgtgacctcctttgtgcggtcgcacagttcaatcccgccgatggcaagcacatcccgttcctgcttcatactgccaccaagctgcatatagcgccgcagctgtgattttacccgcgcctgcagttccaccgggttaaaaggtttcgtcacataatcgtctgctcccaccgtcagtcccagaatcttatcggtgtcctcgctcttcgccgtcaaaaggatgaccggcacgttgcttttctcacggatcttcaccatggcagagataccgttcatctccggcatcatgatgtccatgagcacgagatggatttcttccttatttaatatatctacggcttcccttccgttgtatgccgtaaatacctgatagccgtccgccgtcagatagatttccagagccgacacgatgtccttttcatcgtcacacaccagtatgttgtacattttctccccttttccgcgtaaactccccgcaagccgcgccgcacatgccgcctgccgctatttgacgctttttgattctgattttattgtagcggaatgtttatgaagttaaaagaagtgaattcattaagatttgatgaagaaaggaaaaagacagtagggcgtctttcctcctgtcttttttatatctacatttaattataaggttctattctgcatttaagccatttcctgaccgtccactaatagaacagcagatttccccgcttctttgcctgctttagcatcacatcaaagaacacgcttcctatcaccagccacaccagcgccacgatacacaatcccggcagcatgcctgtatattcaccgccaaccgcgatctgacgcaatatttcgttacatctggtcagcggaatgtaatgcgtaatctttaatatggcatcactggtcggcacggtatccgtcacaaaaagaagcgcggtctgtatcagaaatacgatcgttcccgtccgcttaaagtaaattgcgatacctgccacaatcagacctatgccgtacattccgagggattctaatagaatcggcaccagaaacgccggatgaaaagaaaattcaatcccccacacgaactttgaaatgatgacaacaatcacaatcgtaatcgtctcaagcagtaccgaggagacatataatcctccaaacagatactgtaacggatatttcgaggataccttcttgtacaaggttccgtgtgtcagctcgctctgcagcgatcccgcgacattggaaattgccgagatcgcatagatccaggcaacatatcccaaaagcaccagttccttgtaatttccataatgataggtttgtgcgtaagaatttccggaatccgtcaccataaataccgtaaacaaagcgaaatagaccaataagtcggaaatcatcccaaaccggtaacggatcgaccgcagaaaatccatttttatctcataccagaacattctaaacatctgcccgctcctccccatgatacagtttcttataaatctgcccgatttcttcctctcttccattctccacgacttctgcaaagcgcccgtcctttaggaaaataagcgtatctgcgacatccgatgcaaatgagaaatcatgcgcaatgacaatgatacttctgccatcacggacactgcgtatggtatccgcaaccagctttcggttatcaatatccagtccgtccgtcgcctcgtcaataatcacgcattttgcgcctgtcacaaccgcagacatcagcgatacgatgcgcttctgcccgtacgagagcgtttcgaccagtttatttttcaccgtctcatagattgggaatttctcttttccccggtcaatcgcggcatccgccgtactttttcttgacttttcggacatttgattctaatatcttcctgcatgctttgatatatgatagaagaaactcttttttcagggatttttcgtgtgaaatagagaatacaaaagaggtgccaatgtgaaaatcaggagaaaacatccggtcagagtcaatcatctcgggagcgatcccatcccacagctggtgcgccggcttgcccttccggcaatgctcgcccagtttgtcaatgtactctacagcattatcgaccgcatgtatatcggaaatattgcaaacgtcggggacattgcgctcgcgggcgtgggaatctgcggaccgatcgtgacgatgatctccgcgtttgccgcctggatcgggaacggtggagcgccgttactctccatcaaatccggtgaacagaataaggagggcgcttccgccatcctcgccaactgctttgtgcttctgatcggcatggcagtctgcctgaccatcggagcgtatctgtgcaaggacgccctgctagtatggttcggcgcgacggagcgcatttttccctacgcagaaacctacatgcgcatttacctgatcggaaccgtcttcgccgtgctttcgctcgggctgaaccagttcatcatctgtcagggattttccaatctgggcatggtctccgtcatcatcggcgccgttttaaatattctgctcgacccgctctttatcttcgccctgcacatgggtgtgcgcggagcagctgtcgccaccgtgctctcacaggctgtttcctgcgcattttcgctgtacattctgttccgcggtcccgtgccggtgaaaatcacgttccgcggttactccctcccggtatgccgcgatgtcctcacgctgggactgacgccgtttttgatcatcctgttcgacaatgtgttgatcatcgtccagaatgtcatgttgaaaaattacggcggcgccgacagcgacatgctcttaacctgcaacacgattgtgcagagcttcatgctgattatcacgatgccgctcggtggaatctccggcgggacacagtcggtgctcggctacaactacggcgccggcgacaccgcccgcatccgccttgccgagaagcatattttaaagacggcactgcttttctgcaccatcatgttcgtttttgcccagtgggatgtcagtgcaggcattttcgtcggattatttacgcaaaatgccgcttacagatctatgacggtgcattttatccacatctacacgctctccgtcataccgcttgccgtacaatatgcgctcgttgacgggctgaccggcatgagcctcgtgtgtgcctcgctgccgctttccttcttccgcaaagggatctacatcgcgctggcagtctttttgccgattcgctttggcgcaccggcgatgttctatgccgagccgctctccgatgtcgttgctgccgtcgtcacgacgatcgtctttgtgaccgtcgtccccggactcctccgcaaaagagaggcgctcctcggcaaacacatagaaaaataaaaaggaacgcctgtcagaaaatggaactgtcgcaataagcatagcgtactttgctctgataagtaatattataagaaatagatacttaaaagttccagataaacatgcggcggcaaattctgaccgcaaaatccggtatttctaaccatgccgcagctggcatccgtgatgatccgtgtctttccaagtttggaacactccacggactgtgtccgcaagccagcagacaattttaggacttttgtgtgtgtccctagcggcaccagacaacaggtggcataaatgccacctttatgtcgaacaaaacataaccgcgcgaagccgatgtttgaattgccatctgccatatttttaatagcagatggcaacgagtttcggttcgcgcggttttatattgtctgtgaagaggtgccattagggacaccagaaagtccgctcattgtctgcggcttgtcggacacactccgtgagtgtccaaacgtggccaagacacggaatgggatgccagccacggcatggaagaaatacgtgaattttgcttcaaagaatttcccgccgtctgtttattctggaacttttttgttctctggtattctaataatattacttatcaccccaaagaggtctatgcttattgcggcagttccagattccgatagcgttccatttattaaatctacctttgatttgccggttccatattgacagagcgccctttgatcttggtgttcttcattccctcgaggacttctctgccgtactctctcggcacctccacgaaggtatacttgtcgtacatgtcgatcgcgccgaccagcttgcctggcatgccggactccccggcgatcgcaccgagaatgtctcccggcttgacgcggtcttttttaccgatgttgatgaagagacgtaccatcccttcctccgcgccggtattgtcgaagtcgtagtcatcctcgctgccgttgtcgagattgacctggccgagtgcctgcttcaaaaatgccgctgcaatatccattgcggtgtaatccgaagcattcacctggcgctcgatcatgtcgatcatgtccgacaggttctcctcgtcgatgatcctgccgatctcctccatgaccttctctgccttgatctgtgccacatcatccgttgacggaatcggcattgccacgatcttggtcttgcagtagcgcatgatatccttcagcttgtagacttctttgcccttcacgaaggtaaaggcgcgtccggtccgacctgcacgtcccgttctgccgatccggtgcacatagtattcgtcatcctgcggaatgtcgtagttgaaaacggcctccacatcatcgacgtcgattccgcgcgccgccacatcggtcgcaatgaggatctcggtcttgccgctgcggaatcctttcatcacgcggtcacgctgcgactgcttcatatctccgtgcagtccctctgcaaaatagccgcgtccctttaattcttccgcaagttcgtccaccatccgcttggtattgcagaataccagcgagagcttcggattgtagtaatcgagaagccgcgttaagacttctaccttgtcgctacgcttgacatcgtagtaatactgctcaatgctcggaaccgtcagctctttttttaccaccttgatgttgaccgcatcgtgctgatatttcctggtaatatcgagaatcggcttcggcatcgtcgcggagaaaaggatcgtctgacgtccctccgccggaatatactcaagaatcgtctcgatgtcatcgcggaagcccatgttcagcatctcgtccgcctcatcgagtaccaccgtgtggatcgcatcacagcggatcgtcttgcggcgcagatgatccatcacgcgtcccggcgttccgacgataatctgcgcaccgccctttaacgccttgatctggcgtccgatctcctgtccgccatacaccggaagtaccttgaccccgtgcatatacttggcaagtttgcggatctcgtccgccacctgaatggcaagctctctggtcggagagagaatgattacctgcgtctttctgctgttcgggtctaccttgtgaagcaccggaataccaaaggatgccgtcttaccggtacctgtctgtgcctgtccgatcacatccacgcccgacatcacaaccggaatcgcctggctctgaatcggcgttgcctcctcaaatcccatatccgcaatcgctcttaacacctgaggatataaatctaactcatcaaatctaactgtttccatctttttcctttctgtcacgccagagccaattctctgacgcatgcccagcaccggcagaaagtgcccacttctgccgactgcgcagtattttgaatcatagcacggcatctctcttttgtcaagaaatgcgcaaatctccgaacttctgtctatgtaacccaaatccgctcgcggctttgggcaatactcctatgaaaagcaatcgacagatgcgtactttacttgatctgtactttttcatactgctgtgcttcggtaaaagtaaaaggctcgattgcggattttccgttacagtatattctatgccggaatctataaaagtttcctctcttctccgtatctcgcctcttttgcatccagatgaccgagcgaaatattgttgcggctgcgctttttcacctcgtagagcatcatatccgccgcatgcaggaaatcccagctccggcttccctccggagccacgtcaaaacagattccctgcgagattgtgacaaccggaagcgccttcgagcacacatgctcgatccgcctgtcaagaatacgctcccgcagactgtccgccatggaaaaaacctcgtcctccgtcttgtactcgtaaataatgataaactcatccccgccataccgcgcacagaaggtatcgtggctctgcattttccgcagctcatccgcaatcgccacgatgcaggcatctcccgcctgatggccgtagttatcattgtattccttgaagtagtcgatgtcgagaatctctaccgcaaatgctctatggtcatcccgcgtccgctcaaacgcacgctccagataatcattcagccggaaccggttcgccagccgcgtcagcggatccgtctcggacttctccagcagacgctcattcgctttctccatctcccgccgcttctcattcgcatgttctaatgatctgcgcacggagagcatgttggcaatcatataatggttctcccgatccagcgcctcggtcagctcatagaaccggcccgcctcctcgagataagccgcctcgtcctgtttcctgcggtagcagaggatttttaaggaaactattttccgctgcagattcgcaatattggcgtttttcgtcaatttttccaataccgccacgatgtcccagaagacgtcttccttatcgatctccagcaacagtctgcacagcccgtacacgtcatcaaagatatccataaccgccatgtccatatccacaagtccgcggatctgctcaatacattcctcacgaagtgtgattcttcccacgcggtgataatattccgccttaaaaatcagcgccgagagccgctcgatcttctgcatgtgctcccagcagacctgatccagataatccatctgtgcctgcacgcgttcattctgttcccgctgcataaagcaccgccccagacagaccgctacacagctcatcagcccgtaataattcggggtctccggatatgccttgatatcggaggagactttttcaaaatatctctgcgcctcattccactgttcgttgcccagatagagggttccgagattcaagttgatgacgttttcttcgttcgccagcttatattttttacaataaccgagtccggtcagatagtaatccagcgcaatcggcgtatttccacggttcaaaaaggcaatcgcaaggatattataagccctggcaaccatgtcccactgctccgcctgatccagataggtgatagctctggtaatggtcttaagaagctgctcgccctcattgagcacatagtaggtctcgcccgcataatagtaggcaaaccccagaagctttggatcccccgtctgttttgcatattgttcgatatccgcacagtatttcaatgttttctcggcatcggcgccgcggttctgcatcactccgtccacccacgccatcacagctttactgtattccttgaattccatgtaccgattcctcccttatctcttgtttcattataatgaagaaatccaacatattcaagaaccggtgtcttccttttacaaactagctctgaaaaaatgctaccggatcgacaggctgtccgtctttttgcagcgcaaaatacagattgctgccctccaccgaataatatttcgtcggctctgccacgtagcccagcacatggccggattccacataatcacccaccgcaaagttcggctcctttaactgtccgtagatcgcgcggtagccgtcacccagatcgaccgtcatcgtacagccagtctcctcgttgttggagagaccgatgacttttccctttgcgacggaatataccttattgttgacctctcccgcgataatcaccgccggattgtatttgtactggtccagcgtcgcaaagtatatggtagaatccatgctgtaatttaagatcacatttccctccatcggccagagcatgccgtcctccggatcaaaatgaagggcattgacccctgctcccgtctctgcggtctcattctccgcttctttttccacctgcgccacttccgtactctctgtcgtctctgccgctttctgctccagcttttccgtctccgcggtctgctccggcggaataactgcggatgcctgtgctgtctgttccgtactttccgtcgcagcgacaagtccggcttcctccggtgtgttttcctgtgccagttcttcctccagctgttcgcgctgctgttgttcatgatcgctgtaaattaccgtggtcgcaactgctgccgcaatcacaatcgcccccgcaatcacatattgtttacgcccgaggaatgcccaaaatctgctttttctcatttttttcaccatccatattatttatttttattcctattgttccccctgcacggatggtttatgcagagcgtcgcctattttatctgatccgctgtcacaagcgttgttcccggaaaaaaatattgtaaaatctcctcgtaagaggttccttcctgcgccatcgcgcgcgcctcattctggctcagtccgtacccgtgtcccagtccccttgtcacgatccgcacattttcccccatctgcgtgatcgtaaaacacgcggaattccagcccatcgcctcacggaacgcttccccggtgcagacatactcccccagcatgacctgctgtacatagcccgccgcatcccgctctgtaacctggatctcagacaccgcggacacgtctgcctccgcaaaatgctccccgcaccgctttaaaatgtccgtttcctcacaataaatgaccgagagcgtgccctccgccgtcagatccgccgggcactccaccgcgggaagatatggcaccgccgcttccgccgaccggctcatatctctcgtacttcctgcactgatcgcatgatatgcagcatacgcatagccaccgttccaggagagcacctgcccactcgtctcctccacgcacgtctcaagccgttccatggtcttttcatatgtttcccccagcgcctgccttaattcttcctccgaaaaagcagccggctgttcctcccctctcgccgcggcatcatacagtgttgtccgcgcaatcacgcactgcgccttaagcgccgcatcttccgcgtccgcacggatctccttcgccagaatcaggggcagctgttcctccagttcctccccgccctctctttctgccgcctccgtcatcgcgtcgtacgtgccgtatatcacttcctccagtcgcatacgctgacatattatcgtaacaaaaagcggcaataatatgccgatcagcgcgaaagtaagcattctatcaatatagtatttccattttttccgcataaaaaaatctccttgtccattattatatgaaccaaggagatcttccattcccacaaagccgcggcactagttcagactctgcataattccgaatgtcagtgaaaaaactttataaaacgaatagaaaaagtatgccacggtcactccactgtaagcgatggtatagatgatcgggaacgtcatttttctcttaagcacatgtgctctccagatgtaatagcccggtcttaagaaaatcgcaaacaacaccagaccggtgatcttgtatttctgattgctgatttttataatatccagaatcaacagcacaagcatcgccacaaacagcagattggaaaacatggaaagcatctgcaccgggctgccaaggctcacggatccgtcgagataagcgtctattccttcccctgccatcgcattccatgtcgcgccaaataccacaaaattgataataatctgcgccataaagatcaccaggagaatattgcacagaacatcggataccggtccgtgctgctcctgcggatacggattgccctgccagtttccgtaattcggctgctgatacgggttctgaccgtttccgtaattcggctgctgatatgcattctggctgtttccgtaattcggctgttgattcatgttctgtgcatttccgtaatccggctgctgatatgcattctggctgtttccgtaattcggctgttgatacgggttctgaccgcttccgtaattcggctgttgcggcgcgttctgccggttctgatacattttcgtatcctcaccgtatgttctgggcgcctcgctcccgttccatccattctgattgttctgctgtccatccattgtctgtttccccctattctctctatacctgctgcttcattctgcgtccgataatattcgagagcgccgcaaactgttccaatgtaagcgcctctccacggatggtcaccggcacgccaagctcctcaatgctttcctgaatcacttccttggagagatgaatctccggcgaattattcagaccgttcgcaagcgtcttgcgtctctggttaaaagatgcccggatcagccggaacatcagcttttcatcctccacctgcaccggcacggtctcatgacgcgtcagccttatcaccgcgctgccgacattcggccgcggcataaagcagttcggcggcacgtttgcgataatctccggctttgcataatactgcaccgccagcgagagcgcaccgtaatccttcgtccccggtccgacctgcatcctgtctgcgacttccttctgcaccatgatcgtaatgctgtcaatcggcacatggctctcaaacagccccatgataatcggcgtagtaatataatacggaagatttgccaccaccttgatcggtttcccggcattcttctcctccgcgagctttacaatatccagcttcaaaatgtcctcattgataaccgtcacattgtcataagcgctaagcgtgtccgccagaatcgggatcaggttctgatcgatctccaccgccgtcacctctctggcattttcacacagatactgggtcatcgtgccgatgcccggtccgatctccagcacaaagtcatccttcgtaatgcccgccgcctcaataatgcgctcgagcacatgggtatcaatgagaaaattctgtccgaactttttctgaaaattaaaatgatacttctgcagaaccgtaatcgtattctgcgggattcctaatgttgccatgctgccagcacctcatcatacagtctgtccagaaactctgcatagagcgcgcgaaacgtctcgtgaaacgtctgcgccaccgatgcatctccctttccggtaagctttgactcctcatagagcgcaaacgccgtctcataaagctccggattcttatcgtaaaaaacttccgtcagtccgtcctcaaatgtaaactgtgcctcctgcgagagattttccttaaaatcttcccgtgagatcagccccttctcctcgtaatccgagaggtagatgtgaccgtccgcggacttcacaaaatccgtgaacgcctcgcgcacatcctcgtatgtcaccggctgataattctcgttccagtatttgtcaaatgtttcccgatccgggaactgctcaaaaatatctgtatccatctttctccattccaaagcccgtccgagggcttctatctgtacgactccgctctggcaaaagtcacgtcttcgcagtgctcgtccaggaaatcatagatttcccggactgacgggcattcgccctatcatccgtctaaagtctccgatgcccgctccggcaaatgtcacgtcttcgcagtgctcgtccaggaaatcatagatttcccggactaacgggcattcgccctatcatccgcaacagtcgcgagatatagcctgcaagcaggcatatctcgtgactgtcacgtctggcactgctcattgcttacgtacattataccatatacccactgtccaagtgaaccataatctttctcgaacaaatattcgatttcatcttgcttttgtcgaacatatgtgctattctttaaccgaacatttgttttgccaggaggtgttttcacatgaacattcagcagaatctctccctcatggagaagcttgccatccttaccgatgccgcgaagtacgacgtggcatgtacctcaagcggcgccgaccgcaggggagacggcaggcacatggggaattgtctggctcccggcgtgtgccatgcatttgctgcagacggaagatgcatctccctgctcaagatcctgttcaccaacgagtgtatttttaactgtgcctactgccagaacaactgcaactccgacgtcccccgcgcctcctttaccccggatgagatctgcacgctcaccatggaattctaccggcgcaattatatcgagggtctgttcttaagttccggcatcctcatcagtccgaattacaccatggatctgatttaccagacgctctaccggctccgtaccgtccatcacttcaacggctacatccacgtaaaagcgattcccggcgctgacccggcactgattgagaaagcagggtttcttgcggaccgcatgagcatcaatcttgagcttcccacggcaaacggactgaagcagcttgctccctgcaaatcaagacacacgattctctcccccatgcgccagatccagaatggcatcacggagaaccagaatgaactgatggtctaccgcaaagcgccgaagttcgtgcccgccgggcagagcacacagatgattatcggtgctaccccggagaacgactatcagattatgcgtgtgtccgaggcactctatgagaagtttcatctgaagcgcgttttctactctgcattcatcaatgtcaacggcgattcgtcactgccggtgctccccggcggacctccgctgctgcgcgagcaccgcctgtaccaggcagactggctgctgcgctattaccgctttcatgtggatgagcttctgtcggaagaccgcccgaactttaatatttatctggatcccaagtgtgactgggcattgcgtcatctcgacacatttccggtcgagatcaaccgcgccagttatcagactcttctgcgcgtacccggaatcggatacaagtccgcccagcggatcgtcgccgccagacgggataccgcgctcacctatgacgatctgaaaaagatcggcgttgtgctaaagcgcgccctgtatttcatcacctgttccggccggatgatgtaccgcacgaagctcgacgaggactatatctgctctcatctcatggcagaccacacgcaggttccaacggagctccgcaacagcggttatcagcagttgtcgctgtttgacaccgggcttgccctgtgagcccaccgccctgattacacatagaaaagaggtattttacatgtatgtatttatctgtgaggacagtcttgaaggtatctttaccggtgtctatgacgcctgcgcaagccggctcggtcaccgcaatatccggcttgccaccggagaaccggagaattacgagcttttttccgaatatattcacgtaactccttccgcggataagaccggcaaggtgatccgcaccatcacgtcccgtttcggcatgcagttctatgagtcgatctatcaggcagcaatgtccggcgagccatcctccggcaggaagatggacaaggcagacgccatctatgagaccatcctcctcgcactcgcaagcggagacggtcagaaagtgcttctttccttaggcgaaccgtgtgtctaccggatttttgagctctgccgggcgaccaaccgcgaagcctgccatcatctcgaatttctgcgcttctccgagcttgagaacggcgttctctttgccacgatccatccgaaggacaacgtccttccctatctggcagagcatttcaccgaccgtctgccctccgagaactttatgatctatgacgccacacatcagtctgtcgcggtgcacaaagcgctttccagctacattctcacagatgccgcagatctggatctggagaaagtcagccggtattcctccgacgaggaagccttccggcagctctggctgaccttttttgatcacattgccatagaatcccgcaaaaatccgggcttgcagatgcagttaatcccgaagcgctattgggcagacaccccggaatattcccgcttctgctgattcgggcagacacctaccggacgccgaatacacggcaggcattttcccaggtcgtctgctccacctcctgcacagagacgcctttgatctctgcaatcctggcagccacataagagaggttggaggaatcgttgcgggttccccggtgcggctcgggcgccatatacgggcagtccgtctccaacagaatgtgttccagagagatctgctccaccgtctgcctgagtttctttgcatttttaaaggtaaccacaccgcccacaccaatgcagtatcccatcttcacgtactcttttgcctgctccggcgagtacgagtaacagtgaatgacaccgggatgttcccggaatcttccggtctcttttaagatccgcatggtatcctccgccgcgtcacgcgagtggataattaccgggagatccgtctccccggcaagtgcaagctggcgcacgaaccattcccgctgcgctgcctgtacttccggctccttgtcccagtaataatccagaccaatctctcccaccgctaccgtcttcggatgtgccgtctgcgctttgagccaggaatatgtctcctcgttcagcccgtcaatatcgctcggatgcacacccacggcggcatagatgtaatcatacgcctccgccaacgcgagcgtcgtcctcgtcgtctcaatggacgcaccgacgttaatcaccctcccgattcccttttccgggagcccagctaataattgctctctatcctcattaaatacttcatcatcataatgtgcatgtgtctcaaatatcattgttttcctcatcttccctgttgctgcattgccgtctctttcatgtcgctgtctgtcggcacagcttctgtgcgattgctgtaccgccggctcagccgcagttcttataataaaagactgccagctgtgtgcggtctcgtaactttaatttatccagtatggtgctgatataattgcgcaccgtaccctcgctcaaatacaatttttctgcaatctcccggttgcttaagccttctgccaccagttcaataatgccctgctccttctcactgatgtcgtaatcatgataggaaaagctgccttttcctgccagaagcaccggaatttttcccataatctgtccgccgaatacactctgcccgccgtagacagccttgagtgccggaacgatcgactcaaagtcctgtttcagcagataccccttcgctcccatattcagtgcctttacaatgtattcgtcatcggaaaaggttgtcaaaaacaaaatttttgccgcttgatcttcttttaagatacattcagctgcatccaatccggacattccctgcatgcggatatccatcagcagaatatcaggatgctgctcccgataaagccggatggcgtcatctcccgcctctccaagacccacgaccgtaatctccccgtcagcttccagaatcgtttttagggatactgccaccagtttatcatcatcaaccaccagaactctcatttttctctctcccagccttcattaccgtatctacattttatccctcttgggaatcgaaataaagatcacaaatcccttttccgtatgaatccggaaggttccgcccagtgcctgcacgcgctccttcatattagaaagaccaatcccttcctttccgtccatacggacgacctcttcctcccacaatggtccgctctgtccctttcgtcccaccgttccgttgtcctcaacggtcatctgatagaacgccgggtgctcccgcaaaatcacggagatcttatccgcatcggagtgttttgcaatattcgacatggcttcttttaccgctgtgataaagcagtactttacattgcgtggaatctccggagacatatcgtaatcaaccgtgagctgatagtgctccttcatctcacgggtcgcctccgcaatggactgccgcagatcaatggactcatcgtgcagatcgtgcacgctctcacggatactgttcatcgcctgatttaacgtctcccccaccccggcgagctgtccgtgcagcggctcctccttatgaatcgtaatcagtgcccccatctgcagaatacttcttgaaagcatatgccccacattatcatgaatctctcttgcaatgcggttgcgctcccgcagtgtcgcaaggtagatctcataatcctgtttttccatcaggttcttgtttttttcctgcagcaccagattcaattccgtgctggtatcccgaagacggatcatctcctgttccagatacagaattctgcccgttctgcacgccagcaatatcgcagccacgatcagcataccgtccgccgcccacaaaaagggctgccggataatctgttcccgatagaaaaaagcgagccccggaacactcaagaaccagagccgcatctcctttttttccgcacagtcatacagaagaaccggcacgaaaaaacagagttccggcaggataaagcagaccgcaaacatccccgcaaggcacacacaatgccatcgtctgttgtccacacagctgccatatgccgccgcagtcatcgccaacagcaacgctatgaccggcgctgcaagccttcccgactgtcccgccataagcagaccgccggcaagcaacagtcctttatccacaatccgcttcattctaccctctccctgtccacatatgccgccatatttccgggatatcttccactttcccgcacacgttatgataaccatatcatcattacagggctgccgccacatcttttttgaaaaataagagatttatgacatttgtcacatcaaacatctgacgctgctcactggtaccgccgggcgtcacccgctatactgtaattaccatcaaatgaggaggatttgttatgtcagtacctgttgtagaaatagaaaatctggtaaaacgctatcaggagcttgtcgccctcgatcacttcaatctcacaattgaggaaggtgagatcttcggtctgcttggaccaaacggctccggaaagacgacaaccatcaactgcatccttgcactgcttgcctttgacaagggaaccgtccgggtcttcggccgggaaatgcggccggacagctacgatctgaaacgtcagatcggcgttgtcatgcaaaatgtcgctgtctttcaggaattgaccgtctatgaaaacattgattatttctgtggtctgtatatccgcgacaaagcgctccggcgccagtatgtggaagatgccatcgattttgtcggtctcaacgatttccgcaaattttatccgaaaaagctttccggtggtctgctgcgccgtctgaatatcgcgtgcggaattgcccacaagccaaagctcatcattctcgacgagccgactgtggcggttgacccacagagccgcaataaaattctggagggaatccaggagttaaaccgcaatggcgccacgatcatttacacttcccactatatggaggaggtggagcagatctgtacccggatcgccattatggacaaaggcaaaaatcttgccattggaaccacggaagagttaaaacgaatgatcaaaaagagcgagatcatctcgattgatattctggatcttcttcctgcgcagattgcagcgatccgtgacataaagcacgtctatgaggtgacctttgaacatcactgcttaaaagtgctgtgcagcggcggttcccacaatctgccgcacattctgaactatctgcaggaacagaatgtgtctttcggaagagtctattccgaacttccgaccttaaatgacgtctttctggaaattaccggaaaagaacttcgtgattaggaggtaccaccatgttttttcatacgatgaaatatacactgcttaatctgctgcgggataaaggtcaggtattctggtgtgtcgcttttccacttctgctcggaacgatgttccattttgcattcggcggactgggaagtggcgaaagtttttccgccatcccggttgcagttgtgatgcaagaggaatcctccgagctgcgctccatgtttgattccctgtccaaacccggcgaagatcagttccttgaagttacctatgcttccgctgcggatgccagtgaactgctgaaagcaaaagaagtctacggcatcattaccgctgatctgccaaccgtttccgattatagaaatgccgcatccgccaaggatgtttccacgtatcctctatcgctgacactctccgcagagatgacttccgatcctctgtaccagagtattttaagtgtgcttgtggatcgtttcaacatagaatacagtgccatcgcccaggccgcaatgaaagatcccacgaagcttccggcactgcttgatgcggtttctacggaagtcagctatatccggcacgaatcccttggtgccggctccgtggatgaatcccttacttactttttcaatctgattgccatgacctgcctctatgctgccatgatcggcaacacgctcgccatctccaatcaggcaaatctgtcagatctgggtgccagacgcaatgtctcgccggttccccggctgcttgccaccctcggtgatctgaccggagctctgatttttgagttttcctccttgctgatcaccattgcctatctgacactggttcttaaggttgatttcggaaaccatctcggcggtgtggcgctgacctgcctctgcggttgtcttgccgggctgagtctgggatttctggtcggttgtatcgggcagttttccaaagagaccaagtttggtttcctgatggctgcaattatgatctgctgctttttaagcggtctgatgatcggaaacatgcgtgcacttgtggaagatttctgcccgctgctcaaccgcatcaatcctgcagctctcatctccgatgcgctgtattcactcgtcgtgtacccgtcctacacacggttttttacaaatatcgcaggactcctgttactctcggcacttttctgtctcggcggtcttgcactggtaaggaggaaaaaatatgccagtctttaaagcatttttcgcaatcgcaaaaaaacggcgaaatgccgcattgatctatttgggcgtctacgcggtgatcacgctgctgctgtcggcactctcgcaggattccatcaacgagaacttcaaagccagccagcgctctatcgccatcacagatgaagacaacacggatgcaagccgcgctctgtgcgattacctcgcatccatccaccaggtaacaacaccggagcctggagaggacaccgcactgttagatgcaatctactaccgcacgctcaactatgccatggtcatcccggaaggatttgaagaccgggtgctcgccggcgagaccaaagaccttgtctcctccctgacaattccgggaagcagcagcagccagtacgtggacaaccagattacgcagtatgtgcaggcactgcagctctacctggcgggcggtgacaccattgccgaggccatcgaccatacggatcataccatttccgaccttcccaaagtctccgtcacatcttttcagatgtccgacgccgacaccaacagcatggttttttattttttccagtatcttccgtatatctttctggcaatcctgttcgccggcatggctccgattctggttaccttaaacagccgcgacatgaaagcccggacggcgtgctccgctcttcccggaagaacacgtactcttgccatggcatccggctgtctcctgtacagtctcggcatctggctgctctttctgctgcttggtctcgtattctaccagaaagccatgctgcagccgtatgtcggctatgcaatcttaaacagcctcgctttcctgttttttacggctgcactctccctgctcatctcgacgttctcgccggatgacaacgtattaaatatgctggcaaatatcgtcggtctgtccatgtcctttctctgcggtgtctttgtcccgcagtccatgctctccggttccgtacttgccgtaggacgtttccttcccgcttactggtacatccgcgccaacaatatgctggcgggattcggaaaggaagtcttcgacctaggcttttactggaaatgcatcggcatccagttcctctttgccgccgccatgttcgccctgactgctgtcactgcgaaacagcgcaggagcactgccacataggcagacaacgctgtcctttgaagtgctaagtcatattatccaaaacacattctatagatttcaggtagaactgcataggaaagatttattgaaaaaaatgtgtgcagttcttccagccggatgactgcatctgatttcgtgtctcttccacgtttggactctcccggagggtgtccgacaagccacagacaatgagcggactttctagtgtccctaatggcaccgcttcacagacaatattaaaccgcgcgaaccgaaactcgttggcatctgctattgaaaatagggcagatgccaattcagacatcggcttcgcgcggttatgttctgctcattggtgccaataagggacacacaaaagtcctaaaattgtcttctggcttgcggacacactccgcggagtgctccaaacttggaaagacacgaatcatcgcagatgcagccaccggctggttagaaatgccacattttttgaacaaaatatttcctgtgcattctacctaaaatcgaaaagtgtgattttcttataatatgacttagccttcaaaggacaccgcctgcttcatggggcagtgtccctcgccgttttgttacactgacacatccacagatgcgccggcagcggctggcgctgtgtccgatgcagttcccgctcctgtacctgccggcacggctcccgctgtcgcaactgcaagagttcctccgtcggtaagcgacatctccgcttccacttccgcctctgcctccgcttcgatctgattctgtgccatcatctcaagttccgccatcgacattgcggcatcactgatatccagcgtaaatccgctgtcctcacaataagaactgccgccgccaaagcctttgccagcctcgagctgtgacttgatatatttgaaatccgcttccgcaatcttaccccgctcctgcgagcggtgtctctgctgcttctgcgctatctcgttcttctttttcttctgccgaagcacttcctgcgtattctcaatcgataccttctgcttgagttgacgctctttctgtgccacacggcgcttcacttcatgttccttcttctggctcttaccgctgttttccttctgcgcagactgctgctcgcgctcttcctcgcgcagattgcgcactttcaactgcgcacagcgcaccatccgtctcgcatgcgcaagcgcattcgccacttccttggaatcatactgtccggatgccgccgcacgctgaagcatagacaccttgctctttgcacgggtcagcgccgcggatgcactctgcggcttcttcgcccggagcagctgtccggaaatatctctgtgattataattgagctgttttttcgaggttccccctgaactactgacccccgccatctgctcaaatgtatttgtgctttttcggatggaaagtgtgcctgtcatcgatgcctgattgctcacacttcccggtgcattgatgctgattcccatatccacattcctccctgaatgtatccctgactgaatccgttcatatggtatacatcggctgaaattggatttttcgttaggtttcctgcatgaaacagcggatttctgttataaacgatcacagaagccttccaagcagccagcacatccgggtcacatccagaatgtttgccagcaccagaagcccgagtacagtaaacatcagtttttccggcacaggcattttccccttactgtgtgcaccgcttccgctctgcgcagcatctgcactgcctgtcttccagacgaccctcatgcctcccaagttccacacggcatccgtacacacatagatcagcacgaaatacagatagaggtacggccggtctgccgatgcgtaaatcgtcggtgaaaatcccatgacgacccccgtggcaaatccgcctgccagtaaaaacgccgtccacaggtaatgcttccacgctccatccgccagctgccacagggcgtacaggattccaaaaacggacagtatcaaaaataccagcggcatataggtcaccagctcatgccagtcccagtgtgtcgtctgttccggtcgcacgaacacctttttcaaggatgggtggctgacacgcaccaccgcctgtccaaacagcagcagcgccggaatccccgccaaaagcgtcttacggtaattgcctgtcttacggtacacaagcggcgcaatcactgctgccacaacgcaatagaccggatcaagctgggcaataaagatccgttccacgttggcaagtcccatgtagagcttctcccagaatgtaaaatcagcgaactccggcattctccccgccatctcctgcgcgctccggattgcatttcccggacaactgaaaatatatatgagggaaataatatctatgccgcataatgcatagagaagcggctgtttcatacacttttccgagatataatgcagtacttccatgccaagcagcagaagcagcagcaccgcagcctgttcctggctgcccgcataagcacacgctaaaagcgctgctgccgcctcccacaccggcacttttctgccgcagcgaagctgctttaacaccatgccgatcaccagaacgccccagagcggccagagataattggtcgtcgtcgcaatccatccggcggatgccatatccgcaaacggatagagcagcaccagtccggttacaaaccagcgtccgcgcccggtcacacccagcagtccgcagagcagcaccgggagggacgtaaagatgacaatatcaaggattttccagagcagcggacagtgcaccagtggaattaacaccgcctcgatcaccatgcgcgatgaccatgtctcatagcgatgtgccaggatctcgccgagtgaactgttaccgtccagaagggttttaaaatagaccatatcatcgccgacattcgtggacaataccacatgccaaaggacggcggcaagcgccgccgccacaaatgcaccgttttcataaaaccatgtccgttttgctccggtgtctccttttaacatatttcagcacctgccggcatcggtttctccggcgtcatcagcgccagattgccttccgcatcctcagcgcataaaagcatcccctctgagagaactcccgcaagcttcgcaggctttaagtttaccagtaccatcacttttttaccgaccatctcttccggcgtgtaatacttgcggatgccggaaacgatctgcttcacctcgctgccgactcttacctgggagcacagaagcttcttcgacttctccacagcctcacaggaaatgatctctcccacctggaactgaagcttcataaaatcatcatatgtgatttcttccttcgcctcgatgtcgatgacgtcttctgctttttcttctgcaggagtctcctcgccaagcgctctctgctctgcctcaaactccttcttctgtgcctcgcggatcgcttctaccttcggcatcacatcctttgcatccagacgtgcgaataagatctccggcgtcccggtcactttcgtgccgttctcatacagaccaaactgattcagttcctcaaaaccgcggagctgtgtatgaagctgtgccacaatcttctctgcggtctccggcaggaagctgtacagcagggatgcccccaccgtaatcgactctgccagattataaagtacctctgccagacggtcggatttcgcctcgtccttcgcaagtacccacggtgccgtctcatcgatatatttgttgcagcggcggaacacgccgaatacctcagaaatggcatctgccacacgcagatctttcatcttctgtgccactctgtctctggctccggtcacaactgtctttaagtcttcgtccacgtcctctgtcacgcccgtgcttcttaccacgccgccaaaatacttgttgctcatggaaaccgtgcggttgacgagatttccgaggatgttggcaagatcggaattaaagcgctccaccaccagttcccaggtaatcacaccgtcattctcaaatggcatctcatgcagtacaaagtaacgggttgcatccacgccgaacagatccaccatatcgtccgcatagatcacatttcccttggatttgctcatcttgtctccgccctgtaagagccacggatgtccgaatacctgcttcggcagcgggagatccagcgccatcaggaaaatcggccagtagatcgtatggaaacggatgatgtccttgccgatcagatgcagatctgccggccagttctttttaaataaatcggaagaattgccgtccacatcataaccgatcttcgtgatatagttggtcagtgcatccagccatacataaaccacatgcttcgggtcaaagtctaccggaattccccaggaaaatgatgttctggaaacacacagatcctgtaatcccggaagcaggaaattgttcatcatctcgttttttctggataccggctgaatgaactccggatgggtgttgatatgctcgatcaggcggtccgcatatttgctcatcttgaagaaatatgcctcctccttcgccggctttacctctctcccgcagtccgggcacttgccgtccaccagctgggactctgtccagaaggactcacacggcgtacagtaaagtccctcgtaagatcccttgtagatgtctccctgatcgtacagctttttaaaaatcttctgcacctgtttctcatggtctgcatcggtcgtgcggacaaagttatcgtaggacgtgttcatcagatcccagatgcgctttacctcgcctgctacgttgtctacatattcttttggcgtaatgcctgctttttctgccttctcctggatcttctggccatgctcgtctgttccggtctggaaataaacgtcgtagccctccagtctcttataacgcgcgatcgcatcagcgagcacgatctcatacgtatttccgatatgcggcttgccggatgtgtaggcaatcgcggtcgtcatgtaaaattttcccttgtcactcattttgtctgctccttcctaataaaacaaaaaaatcccgtcttcggggctgatatagccaccagaagacgggataactcccgtggtaccacttctattcacacagaatctgcactctgtgcctctgcggatatcgcaacgaatatcccccgctgtaacaggcggtcccgtcagaacttatcgctgtccttagtaacgtccagtgttcagtcctgccactccaaagccatcttccatccgcccttcctcatttcctcgcagcaagctgcaaccgcgcagctggaaatctctctgtaaagtatctgctgatgtactctctttttcctcgtgtttgtgtgtatcgacttttctaagattagcaccaaacccgcggaaagtcaagcgttcataagcacaagagcgccagagaaaaagtattttacttttccacatactcttcccgcagcgggtcttctgcagcgatcgatacgtcttccagggtaatttcccgcagcggactttccggcaggccgcagagtgagacaccgatggcagcatggtttccccggatatgggcaaaacgaagctccgaaaattccggagccttctgcgacaccggcactgccgtgctggaaccgtaattcatgcttacctcgatcgcttccttttctatctcatccatctgcatccgttccacattgacccgctttacatagccaccgcgcccacgcatggatttgatgcggatgccgcgctcggtccctctggccacgcagtcgtggatccagatatcacaaatgccgccggacattccgcttccgattgccactgccgcgtgtcctcctataaagcggcaatttttcacctcaatctgttcgcagggacgtcccactcgccatccgtcctcgttcatcccggaattgatggcaatgcagtcatcgccggtctcaaaggtacagtcctcaatgagtaccttcctgcacgagtcaggattgcagccatcggtattcggtcccttggtgttcactgtcaccccacgcaccacaacatcctcacagtacaccggatgaatcgtccactgcggtccgtcctcgatcgtaaaatcttccagcgttacatgcttacaatttatgaactggatgaacgaggggcggagcgcatccttcctggtcgcaaatatccgctcttctaccggaatttcctgactttccgcacggatcaggtgatccgccgcattctgctggagctttttccagtgccaccacgcgcttcctgcaccgtctaacacaccggtgccgcagattgtaacgttctcacagtctgccgcgtagataagcggcgaataattgtaacattccacgccttcccagcgtgtaaataccggcggaaggtaatcctccatgcaggaactgaaatgaatcacgcatccctcttccagatacagtttcacattgcttttcagatgaattgcaccgcttttccactcgccgcgcggcacgattactgtacctcccgacgcaggaaggcgatccaccgcctcctgaatgacattctgatttccttctgtatacacacatctgatttccatgtgactctctcctttttcttatcctgcctgcttcccatgccatctccgggttcttccgccatatggcttcttcccgctatatggcttccacatgacttcttcccgcggttttctacattcccggcagaagcatggcgcataccggcaggatcacaatgctgagcagggtcgtaatgaccacgctgcccgccgcaaattcttcatcatacgaatactgcaccgcaaagacggaggtgatcgccgcgctcgggcatgcttccagcagcagcaccacgcctgcagccatcccggaaaagccgcatgcaaaaaacagcgcgaagcacacggcagggatcagcagcatgcggattcccatcacagataaaatgcgccggtcgcaaagcatctgcgccagattgcttccggcgatcatcattccggtaataatcatggagagcggcgtattcatatttccgatcagcgcgagcggctgttcgatcacctccggcacaggaatctggcacaggtagatcaccagtccgatcaccacggcaatcagcaccggatttgtgcagactgtgcggacgacctctttcggctccacggttcctgtaatcatgccaaatcccaccgtccacagcagaatgttgaacaccgtcacgtacacactcgcatagatcagtccctccgcgccaaacagcgcctcgatcagcgggaaccccatatatgccgcattggaaaatatacaggcaaaccgcaggatcggacgttcctttcctttcatccggcaggtacataacatcgtaatcgcaagtccggccagaatcgcaagcacactgaacgcaaacgtctgcggcagtctggcaagcacggagcggtctgcctttgagatataggaatgaatgaccatcgccggcaccgccaggtagagcagcagattggaaaacgccttttttgcctccggctttatgacaccactctttacacccgcaaacccggccaggatcagacagtacagtatcacaacctgttttgccgtaatgattgccagttccataaccctctgcctcctttcctacgcaaaatattccggaaacgcctgccggatcgtgtcgatgttctcggtgtagcggagcatatgccgtcttgcggtctccgccgcccgctcccggtccctcgccgcaatcgcatccaccagctcctcgtggtcggatacaatgccgttgaccggacggcagcggaagcttaacaccgtcgtgcggtcaaaatgcggcgacaggctctccagaagcgtataccagtaattccggtcgcacatctcatagaaatgccggtgaaattccttgtcatattgcagtatcttgtccgtctgcttccgctccatgtacattttccagatggcaatattctcgcgcagcacatccagatcttcctccgtcagaaggtcacatgccatgactgccagctcggtctccacaatgctgcgcagatgccgcacctcctcgaccagtttcaaatcaatgtgcgacacataggtgcctttcttcggtcttatatgcacgagctgccgctccgcaagcgcaagtaccgcctcccggtacggcgtgcggctcaccccgagctgcccgctcagatcattttccagcagcttctcccccggttccaaatgtacgtttacgatattgtctatgagcacccgcgtcacgtaatcccgcgcggactcacccttcttccgctccatgatggtaagcatcggtctcctcctgtactttctgcctgtatttctgcgcttctttggcatgatgagcaatatttttccggcacaacaaaagcgcggcagtgatatatataacagaatatgttatatatatcactgccgcgttcttccgtcaaataaaaacatgggaaaacatttcacttttcaagctgctccaacgcaattccgatcagcctgccgacgctccataaaatacctaaagggtatgctgtttgcataattgtttattatcatacatataagaatcggccttatccaataatatctgcattgtacactccttatagtcttcggataacgcccatccgcatgcataatcgattgacataggattttcattgccatttaatctatctttttccctgcgtaagtattttaaaatatcctcaacttccgctttactggtatgatatataactgccatgaattcatccccgccataccttccaacaaaatcttcttccggaatcacactgcgtaaaagccgggcaaaattcattattagctggtctcctgacgaatgtcccattgtgtcatttaccgtcttcaaattatttagatcaaacattatgcatgctgtcggttcatcaatgatctctttattattaagtattttctcacatgcacttttattgggtaatcctgtatggctgtctgtatatgccctctgttctaacagcttgttttgcactgccatcttcattgccatcagcgtctgcataataaccaatattaccaggcacaacatatcaagtgctgacaaaatctctatggtacgaatctttcttgcaatcttttctgaataattttccgctgcagatactgtttcatctgccatcttaaaataagtttcactcatatttacaatatctgtattttcatatcctctgcttctcaccgcttcaatttctacttttaatttttcccagtagtcactctgaacctgtaatttatcctgatattctttatcatgaagctttaccagatcataatgtccatcctggtattttaatccgctcagaatatcatccagatactgaactaattcttcattctggtttcctgtaatttctaactttacttcacgctgtgtggctccacgtaccagacctgcataatttattacccgtgcagtcccctgtaacctgttgatctgtaccatcataaagacaataagaactaccaataccaatataagaccgctttgtgtaatgccaattatatttttcttttccttattcaactccatctctccgtttacccctataccttcaataaccttcatttcacctttaactggatttatttttaataatgattatatcctctctctgactgtgtgtcaaaaaaacagggagcagattctgccctgcagaatctgctccctgtatggaactcatattctatcttttatacttccggtcttacaatgacaaaacgataaacaatacgttcaccgcacaacagacaactgtcagtgccgtcaggaacactgcggacggcactgccgctttggaaaccgccgcagtcacgcccgcatccgccgccggctctgctttccgtccagataccgccacagccgccggctccttccacacgctgcgctgccggcagatgccaaacagtgtgaccgccagaagaatcccgtacagcggcgcatacacgcgctctcccgagacgtagatcgtcgccataaagcccagcaccatcccggcaccaaagccgcaccccaccagaagcagcacgctgatgaaagtaaacagatcgtcgccgaacagctggtacagcgcataaatcatcgctgccaccgtcactgccagatacaccataggaatccacgtcgacagatcgctccagctccactccagaatctcccccggcatcacgaacagccccgagagccccggatatgcagttcttaacactgtctgcccgaacagaatgagcagcggaagcgccgagagaaacgtcctgcggtaatcttttgtcttctcccagacaagccatgtccagatcagcaccaccagaaaaaatacaatgtccgcattggcaataaacacgcgctcaatactcaaaagtcccagatacagcttctgtccgaatccaaacgtcgcataaaccggaagatccgcaatactgaccgcattgcgtccggcattgcccggacagagtgcaattacgagcagtgaaaccacatcgatcaccgcaagagtccaaaaaagcactgcatttcccggccttctgtgcgctttccacagatacacgccgctaagcacgagcagcagcgtcataatcacggcatactgttcatgacttcctgtcacaaccgcgacaggaaccgcggacactgccgctgccgggtgaattttctccgcaagcgcaagcttccttatcacccacgccacataaaaaaatccccagaacggccagaaatgtgtaactgttgtcgtaatccatcccgccgtacccatgtcgtgaaacggaaaaatcagcaccgccgctgccgcgcaccagttcatcgtcttcccaccgccgaaaagcccggacagcagaagaggcagcgtcgcaaacagcagaaaatcaataattctccacaaaaccgggcactgtatgacattgaccagtacacactccgacaccacgcgcgacgtccaggtcagatagcgctgcgtcagatacgcccacagcgtcgtgtcttttgtggcatcccggaaaaaaatgtcgtcccccgccatcggcttcatcccgacgtggtagaccagtccgatcaccgccaccagcacaaacggaaggtatgccgcgtatctgctactcttcctcatacatatcatccatcttcgtaccacagttgctgcaatatacagcaccttccggcatcttcgcaccgcacttcggacattctgcagaaccctggatccgcagaacctcggctttcatgcgctcgatctcctccacagcttccttgatcaggaaaaactgctctgcttcttcacattcttcctcatccttgtgcttctcataataagagcgtcccagctcctcatactgcttctgcacatagtcctccttggacttgatatccagctttaactttgcaatctcggatacatccttcgccttctggctgacatccttccccgcacttaccagtgactcgcttaacttatcaaaaaattccatgaagttttcctccctgtcgtttctttttccccagtataacgccaatttccctttacagcaatcgaaaaaacaggaaaaatctttttctgcaatatcttttcatgctaccgcatgcagatatacacaagatagaccgcatagagcgccagcatcacaatgccctcgaagcggtccagcttcttcttcgtccaggcgaacgcccacaccagtacgctcatcacaaccagaatcacaatatcgatcacattttccatgataaatgcgatcggactgatcgttgctgcgataccgagcacaaacagaatattgaaaatattggagccgatcacattaccgagcgccatatccagttcatttttgcgcgctgcaaccactgaggtcacaagttctggcaggctggttccacaggcaacaatcgtaagtccgatcagattctggctgagtcccagctttgcagcaaccgtggatgcgccgtttacaacaaaatccccaccgaacttgatcgccacaataccaccgacgataaacacgatacatttccacaccggcaatacctcatactcatcatctccggcagcagcacgcgctttcagtgccgagcgcaccatccagaccagaaaagcgacaaatacaataagaaggatgattccgtctgccctgccaagctgcattcccagatatccgcagactaaaagcaagactgcacagactacagaaaacggaaactctttttttaacgtactcttttcaacatagagtggattaaaaagggcacagaatccacagaccaccatcagattaaaaatattagagccaatagcattgctgactgcaagtgcattattgttcgttaccgatgccgtaatactgaccgcacattccggaagactcgtccccatcgccacgatcgtaagtcctataatgattgagggcactttcagcatctttgccacggaagagcttccctccacaaaaaaatctgctcccttaatcagaagcacaaatccaacaacaagcagcacaactgcccaaagcatttctgtcataataatctccattcctctctgttttctctactgtaattattttctcaaaattatctcaacttccggtagtccagcacctatcccacaaacccgagatgctccagcagaatcttcacgccgatcagcaccaggataatgccgcctgcaagttctgcctttttcttgtagcggtttccgaagaaattgccgacatagacgccgccgatggagatacaaaacgtggtgagaccgatgatcgtaaccgcctccccgatcggataattcaaaaatgcgaatgtaattccgaccgcaagtgcatcgatgctggtcgccaccgccagcacaaacatctcttttacgtcgagcggcggatccatcttgtcgatctccacattctcatcctccggccgcaccgcctcggcgatcatcttgccgccgatgaataccagcagcacaaaggcaatccagtgatcaatactggtaatgtagctctcaaactgtgtgccgagcgcccagccgataaacggcatcagcgcctgaaatcctccaaaaaacagaccaatcacaaacgcctgcttcttatttaccctgcgcatcgcaagacctttgcagatcgacactgcaaacgcatccatcgaaagacccactccaatgagcagcaattcaataaaaacagccataccaacctccacattttattctgcccctgccacagggcgcacatacacattcagcccggatgatgcatttcccgccggcgcacacataaaaaagagactgatgtatatcctctgcgcaccgctcccgtctccgtctgcgatataacaccaaagatatacatgagtctcattctttaagatttgccaggtcaggctgtccgaccggtctgttgacaaatcacgctctgcgcgaactactccctcacggaatctgcattcatcaataacgctgttttcttactatatagcagcccgcattttttgtcaaccaatttgtcaaaaaaacaacctttttatcccagaagttcgagaatttcctccttggtaaaggaaacggaatccattccctccccctcgagcacctgttttgccagttcttttttgcgctcctggatcgcaatgatcttctcctcgatcgttccctcggataccagcttgtagaccgtcacgacatgcttctgcccgatgcggtgggcgcggtccgttgcctggttctgcaccgccacgttccaccacggatcatagtggatcacaatatccgcggccgtcaggttcagcccggttcctcctgcctttaaggaaatacagaataccggcacgtcgtcctcgttaaagctctccaccatctgcatgcgcttttccttgccgacagaaccggtcagcatatagtagtcaatcccggccttcttaagccctgccgccagacgatccagcatggacgtaaactgcgagaacaataacaccttgtgcccggcaccaaccgcgttctcgatcagttccatgcacatctgcgcctttgcggactcccccttatagccctcaaacagaagccccgggtcacagcagatctggcgcagtctcgtcagctccgcaagaatctggatcttctcggagcggaattccttctcggatttgccctccaggctctccttcatgcgctgcacatgggcgtcatagagcgcaagctgctctccttcgagcttcgcgaagacattctcctccagcttcgccggaagatcccgcagcacttcccccttcagacggcgcagaataaacggccggatcatgcgctgtaagcgctgcatacggttttcatccccgtttaccacgatcgggatctcgatctcctctcggaaccgctgataagtatataaaaatcccggcatcagataatcaaaaatgctccacagttcgctcagccggttctcgatcggcgttccggtcagcgccagcttgaaacccgcagtaatctgcttgacgccttttgccgcctgggttccagggttcttgatatactgcgcctcgtcgatcacctgaatcgcaaacaccatatcgcggtacagctccacgtcgcgttttaacaggtcgtaggacgtaatcagcacttccccttccttcgtgtgtctgacaatcctctggcgctctgtggcgagtccggtcacgagcgtcgtcttgatctgcggtgcaaaacggctgatctctttctgccagttgtagacgagcgacgccggacatacgatgagggaacggtgccactcccgctctcctgccttggcactctcctgttccgacaagagcagactgatgacctgcagggtcttgcccagtcccatatcgtccgcaaggattccgccgaatccgttctcgcgcagtgtctttaaccacagaaaaccgctcttctggtagccgcgcatgatactgcggagcgaatccggcacctcataatcgctgtcctcgatcgtcttcatattgcggaccatgcccttgaactcgcggtttttctccacggaaagctcctgattgctctttaacgccgcgtccagatacatcgcgcggtattttggtacgttcacatgaccttttttcagtccggattctgtcaggcggagatcctcgctgatctccgcaagcagtcccagaccatcctcgcgcacatcaagaaaatctccgtttttcagacggacgtatttctttttccggtcgtaccgggtcagaagatatgccagctcctcgcgcgacatctcatccgagtggatctgcaattccagaagatcgctctttagcgcaacgcccaccgaaaccgacggcgatgagacgaccttcattccccggaaatcctccgtcgtgtagatcgacatatactcgctgaggcgctgcagaccgctgcttatgagctgatagagcatgtcctcgttgtgcgagagaatgaagatcgtctgcccgagtccgtattcgttgaagtacggctcgaccagcgtgcgcacgcgcatctcctccccaagatcccgcacctcgcccggctcaatcttctgcaatacgttatatttgtcgtccccgtaggcagcgaccagcttcgcaccgaccgtctggttgtcctgcttgtccagatacagttcaaactccggctttttcgggacgtagagcgtctcatcgaagccctccgccgtcacccggaacgtctctcttaaaagcggcagcagatcccggcagaacgacggcagttcatccgccgcaatgtaacattccccgccggcctgacgctccatatagtcgaaaaagtctcccgtcttcgcctttaacgcctcactgctgcgatagatcatgccatcttcataaaaatagtaaaatctgcttccccttatgacctgcagatcctccagcagaacgaaaacaccagacgcccctgcgcggatctcaagcttcggcttgcgctctccctcctgcacatgatactcctcctccggcagatacccgatttcggcagataaaggcatttccccgatggcgtcaaaaaaacggtcgatgccgacctcatcgagctccatcgtgcgctcatatcccccagtgtaagcataataggcatgaaatctgctctggcgtttcttgtcgtcatcctgcatccgcatgaactctaccatccgccatgcatcttctgtaaatgcctgtctgttgtgataaaagtccagctttttaccgtaatgcaccttttcattccgctcgatggaatgtaaaaaggcagaaatattctttaatacatacttctgctccattccgatcttaaattccaccgtcgcataactgtaatccagcttaaaataaggctccagttccacctttccatagacgctctctggaatcagatagctcacaccggcacgcagtgaatactggttcaaaagcgtcttgaacgctcctgccgtctgcatcggggcgacaggcttctcctccgcggcgcttccctgctctcccgcctcatgtccggtgcgcttcgcagccagaatgtccttcgcctgccttcggttaacataagcaagaagcgctgcgacacagtgtttgcacattccctcataattataaaacgcttcgcaggtacagttgctgcttgacaccgtgccgtactcctcatcgacaaccgccgtcacccggtagctgctctgttccttcccacgtacctccgctcgcacctcggcaacgggcagatcatgctccagataaatatcatacgcgaaatccagcacgccccctgtctcatataattcctttcctctccggtagactgccggatacacatcctctttgatatccgatacggaaaacataacctctcctcctgcttttgccctctgttctctgacatataattgtaccataaaatccttttttcttcattcttttcttttaatttttttgtcaaaatatggtacaatggtacatatcttgtgattgaaatacttcttattttttatgggggtctgtcatgatacaatatacaatccatgaagttgccggtttgcttaatatctccaccgacgccatccggctctacgagaaggagggtcttgtctcacccacccgcaatccggagaacggctaccgctgctatgacaccgaacagatccaccgcatcatgggagtctgtctctaccgcaagctcaacgtgagcatcgcggagatcaagcggcttctcgctgtctccacccttggtgatctttccgaaagcttttccggtttcattgattcgcgcaaaaaagagatcgagcggcttaccctggaagtcgaaaaaatgtcttatatgaaacagcacctggataccctggatgaaggcagccgcactataagcatccggacgcttcccgctgtctatccgctctaccatcaggattccgcttttttaggttaccgcacgctaaaggatgtctttcattctccgctgttttcgatggggaatttcagctacatcctctccgtggaaccgtccggttcctgccaggtcagcgccttccagtttgccatccgcgagccgatgcttgcactcacccagctcaattccaccaatctgcccagccgggacagctgccgctgtctctacaccgtagtcgcattcccgaccgagcaggagatactctgggatctctccgccgtcctgaaatacgccggggaacatcagctttcctgcaaactggaagcttacgctttctacgtcttcagcatagcacagccggatgtcatcctggattattacgaagtatatcttccgttggaagactcctgattttttcaacctcctattgaccttagacctgcaccaaggtctatgttagtatcacaaacatctggtactttcgtacaggaaaaggaggtctatcatgaacgattcaagagagttaacgttacaggaacgctccacaaagcgtgccaactattgtctgatgcttacagttctcatcatttccatctatatgatgtttctgtttataggaacaattctgcagggaaatcatgctcttttccgtctttttgtcattgcaggcatgattgccctccctgcagctgttagtacattgttctatttttttaatcctgtttccatacgctaccgcaatgtagcgattacatgctttctgatcatttatgaagtcagctgtctatcctcaaaactttttgtctataatctctttatgattcctgtgctcgtggcactgctcatgtattttgatttaaaactcgagatctgctcaggcgttttaaacatgatctgctgcatactaaatggtctctattccatccatgtgcttggaacgaattcacttgcagaaagaaacctgatctttgtcatctgttccattattattgtcatcaacacaatcacctgcctggcgtcccgcgtggccgtcctgcacaacacagaggagctcgccgaactggaagcccacaagaaaaagcaggaggatatgatgaattccatcgtgaccgtcggcacatccgtcaatgaatccacccagtccattcatgcgctgatcgaggagatgacagaggcaaccggctgcgtcagccaggcaatgggcgacattaccgtaagcatggagagcacagtcgcaagcattcaggaacaggcttccatgaccggacggattcaggacatcattgccgataccgtgtcgatcgcagacgcacttaccaacatctcccagtcttctggtaaaaatgtagagaccggtcaggcgcttgtgagcaatattgtctcccagacggaggaagtagaatccgagaataagctcgtcaagaaaaatatgactgcactgcaggcacatacgcaggacatgttaaaaattatcagcattatccagcagatctccgcacagaccaatcttctcgccttgaacgccacgatagaagcagcgcgcgcaggggaagcaggcagggggttcgctgttgtcgcggaggagatccgcatgctctccgagcagaccaagcagtccactgaaaatattgaggaaatcatcacaaagctgaatcaaaatgccggtgacacaatcgcctcgatggatcatgtcatggacaagatcggcaatcaggtcagcatgattcatgatattgaagaaaatttcagcggcatccgctccggtctgaccggccttgaacagaatgccgccgccatctcagagaagacacgcattttaagagaaaccaacaccatgctggtcgatgagaccaacacgctctcttcgaccagcgaggagatcagtgcctctgcggaggagaccaacgcgatgtgcaccgacaatgccgagcgcttcaagagcgtcaacaatgtcatcgcggagcttgccgccgaagccggcaaaatgaacggttttatcgaagagtaccaccgcctgcacgacgcggacaccgacgccgagacggcaatctcccggcaggcgctccacacggcatagaacggggcgattcagcaattcatgctgacgtccggaagaaatccgcaagcttctgccggctgccgggagtcacgattcgtttgagcaaaatagcgcgatttcttccatgccgactggaacatccgggttcgtgtctcttaccacgctttgacactctatgcgggtgtgtccgcacagcaaagacaatgagtggacttttgggcagcgcttggcacacctctttacagatttaataaaaggaactgtcacaataagcatatcgcactttgctttgataagtaatattacgagaaatagatacttaaaagttccagataaacatgcggcggcaaagtctgaccgcaaaatccggtatttctaaccatgccgcagctggcatccgtgatgatccgtgtctttccaagtttggagcactctacggactgtgtccgcaagccggcagacaattttaggacttttgtgtgtgtccctttatggcacctctgaacaaaacataaccgcgcgaagccgctgtctgagtcggcatctgccctattttcaatagcagatgccggcgagttcggttcgcgcggttttatattgtctgtgaagaggtgccattagggacaccaaaaagtccgctcattgtctgcggcttgtcggacacactccgtgagtgtccaaacgtggccaagacacggaattggatgccagccacggcatggaagaaatacacgaattttgcttcaaagaatttgccgccgtctgtttattctggaactttttgttctctggtattcctgtaatattacttatcacttcaaagagatctttgcttattgcgacaatttcttatattttgctcaccggtgtgccaagcactgcacaaaaattttaaaattgtcttttgctgtgcgaacactccccatagcgtgttcaaagcttggaaagacacggacgatcgcagatgtgagaacagcatggttagaaaccgccggttttgcgatcgaatcgcgactcccggcaaccggcagaatccggcggatttctccggccgccgtcataatataccaaagcgccccggtttctgccgcgtcgcgcgggctagaagattaccgtcacctcggtgcccacgccctcctcgctggagagttcgatctgggcttcgtgctgcacgacgatgtgctttacgatcgcaagcccgagtcccgtaccgcccgtcgacttggaacggctcttgtcaacacggtagaaccgctcaaagacacggtcctgctgctccttcgggatgccgatgccggtgtcgcgcactgtgagcgccggtctctggttcttcatgcccgtaatgacggtcacactgccgcccttcttattatagcgcacggcattgctgcacagattgtagagcagttcctcgatgagcgtcttgttgccgttgatcgtcaccggcccgccttcctgcagcaatgtgacctcgttcttctgcgccgcaatctgcatctgatcgatgcaggtcgtcgccagcgcatagagatcgatcggctcaaactccagcttgaggtcactgttgtcaagctccgagagcttgatgatatcgttaatcaaagattgcagacgctccgcgctccggtgaatctcatttgcaaaatgctcggtgtcgcgctcgttggtcatgccgcttgcgatcagttccgcgtagccggagatcgccgtgagcggggtcttgagttcatgcgatacgttcgcggtaaattcctgccgcatctgtgcatggtttaagatatccatatgctgctgcttgatcatcgacacaaacggacgcatctcctcgtatacttcccgctcatcgacgagcacaatgttgtccgccatcttttcgatcggctccacaaagcgctttgtcatgcgttttgcaaaaaaggcgcacaccaggaatacacacaatcccacacccagcgtaagcatcgtcatattccatgccagatggtagatgctgccgctctcttttccgattctaagaacatttccgtctgagaggcgcatcgcataatagaatgtgtgctccgcggaagtcgtcgatttgcgcatcccgcggccttccccgaccgcaagcgcccgctcgacctccggacgccccctgtgattctccatcttcgtctcgtcctccatgctgtcatagagaaccgttccatccgtagcaatcaaagtgatccgcagcccatcctcggaaagctgatcgcacactttctgcgacgcatcctcaaaatccagccgggagatcacatgtgcatttgcctttaagtcatcatagatctgttgtaccagaatgctgtaaaacagcccgatagaacatacggcagtcaccagaatggcgattgccgcaatcaacataaatttggaatttaattttttcttcatagatttttgtctactcgatcatatatcccacattgcggatcgtcttgatgcagcttcccgccgccccaagcttctggcgcaatgtcttgatgtgcatatccacggtccggctctcgccctcgtactcaaagccccatacctgatccatgatcttgtctctggacaggacaatccccgcattgatcataagatatttcaacaattcgtattccttgaacgtcagctcacacggctcatccccgacaaataccgcgtgcttgtcgttgtccatcctgatctcaccatggcagattttcgtctcctccgccacactctgcgtcctgcgcagcagcgctttcactctggaaatcagctccatcacgccaaatggctttgtgatatagtcatccgctccgagatccagtcccttgaccttgtccagctcactggtctttgcagtgaccataatgatcggaatggctgccgtatttttattcgcccggagttttcccagaatctccagaccgtcttcatccggaagcataatgtccagcagcagaagggacggaaccgcccgctccagccgtttaaacatgctttctccgctctcgaattcctccacttcatatccgctgttcttcagcgcatagcgctcaatctcacggatgttgacgtcatcttccacaatataaattgttgccattgttctcctctcttccgcggccgcttatgcacaccagatcgaagatacgaattacagagagtacctgcttccgaactcatccagcagtctggtgaactctgcgctctccgcctcatccagctgctctgtaaagctgtgctcctccagctgtgtatccttcagctgcatcatgtacacggcaatattggaacagtggtctgccacacgctcataattcatggcaagatccgacaggaccagtcccagctccatactgcacttgcccttgcgcagccgcttcatgtgatgcttcttcacatctttatttaattcgtcaattacttcctctaacggctccaccgtatgcgccagcgcctgatcgttgttcacaaacgcatccgtggttcttgtcagaatgtcacggattgccgcaccgtagagattcatctcctcttcacctttcctggaaaacgtcagattttccttgcgcatctgctgtacgctctccaccacattgatcgagtggtcggagatacgctcaaaatccgtaatacagtgcagcagcgacgtcacctgcaggctgtccttataggacagattctcactgctcagcttcgtcagatatgcggtgatcttgtcgtcatagacatcgacccggttctccttgtcaatgacatcctgcgctttctcctccgaatactcgcccagcacgtccatcgcctccagaaatccgtctcttgtcatctctgccatctggcttaccagtgaacggcactgctcgatcgcgaatgccggcgaagaaaggaatctgtcgtccaagattacaaacgcatcgtttgccgtcttcttctcatcctctgtcttcggaatcgtaagatatgccagattctccagtcccttcgtaaacggaagcagaaccagagtagtaaatacattaaaaatactgtgaaccagcgcaatatccgctgcatttacgacgtcgttcgtaaacggaaagctgaaaatggcattccccagataaaacaggcacaggaaaagaaccgtaccgatcatgttgaaatataaatgtacaaacgcggtacgctttgcacccttgttcgcaccgattgcggagatcattgccgtcacacaggtaccgatgttctgtcccagaataatcgggatcgctgtgccaaatgtaaatccaccggttaccgaaagcgcctgtaaaataccgacagaagcggaagaactctggatgaccgccgtaagcagcgctcctgcaagcactccaagcaccggattcttgaacatggtaagcaggttcgtgaactccggcacgtccgcaagcggctccaccgcaccactcatcgccgacataccgtacatcagcacgacgaatccaagcagaatctctccggtaatcttcttcttatcgctcttgccagacatcagcagaataataccgatcatagccagaatcggtgagaacgatgtcggctttaacatatttataaaaaggttgtctccctgaattcccgtcaagctgagcagccatgcggtaatcgtcgtaccgatattggcacccatgatgattccgatcgcttgtgaaagcttcataataccggaatttacaaacccgacgaccataaccgttgtcgcggaagatgactgtatgaccgctgtgacgcctgcaccgagcagtaccgcttttaacggattcgatgtcagattctccagaatgcgctccaaccttccgcctgacatcttctccagtcctgcacccatcacgtgcattccgtataagaataatgccagcccgccaatcagggacaatactccaaaaatatccattctaatctcctttgcatctcattgctttacatcttttttacatacgcatacataatcatttataacgtattttttgacgttttgcaattacaatccaaggagtcggtaaaattttttaatttcaggtaattttccggtaagctttatgtaaaatctgtgtaaaatcacggtttttagaccaattttctacttctcgtgctctcccgtgatcgaatagatgacccactcggcaatgtttgtcgcgtgatcgccgatacgctcaaaatattttgccaccatcagcatatccgtcgcctgctcgccgtttttgacgttctcattaatctttttgatcagctgctgcttaaagtccgcgaacagatcatcgaccacatcatcctgcgcaatcaccgtgcgcgccagctccagatccttgttgacgaatgcgtccacgcacttgatgaccatatcagtagtctctttcgccatactttccaccagatcaatgttgatcgcgctgcgctcgtatgtcgcatcggacatcagaatcgtcatctcggaaatatccgccgcatggtctccgatccgctccatatcggtaatcatctttaatgccgcggagatcagacgcagatcctttgcgaccggctgctgctgcaacagcagcttcatgcagagcgactccacggtcttttcctgctcgtcgatctcctcgtcgtaggcgatcgccttcttcgccttctccacatcctggcgcaccagcgcggagatccccatctcaatcgcgtgctcaatcatgcttcccatctggatcagttcattgttcagttctaacagctgtctctcaaatctgtttctcattgcttgctcctttcatcaaccgaaacgtccggtaatgtaatcctctgtccgcttatcctgcggcacggagaacaatttttccgtatctccgctctcaatgacctcgccgagcaggaagaatacggtcttatcggacacacgcactgcctgctgcatgttgtgcgtcaccataatgatcgtgtattttttcttcagttccaccgcgagatcctcgatcttcgaggttgagatcgggtcaagtgcagacgtcggctcatccatcagaatcacttccggatcgaccgccagcgcacgtgcgatgcacagacgctgctgctgtccgccggacattccgagcgcactctttttcaaccggtctttcacctcatcccagatcgccgcatcgcgcagggatttttccacgatctcatccagttttgccttggagcggatgccgtgcgtgcgcggtccgtatgcgatgttgtcataaatgctcatcgggaacggattcggcttctggaataccatgccgacacgcttgcgcagcaggttcacgtccatgccgctgtagatgtcttccccgtcgagcagcacctgtcctgtgatcttacatccctgtaccaggtcgttcatgcggtttaagcattttaaaaaggtggattttccacagccggacggaccgataaatgcggtaatttctttttcgttaatggacagatccacgtccttgagcgcgtggaaatcgccgtaatacagattcagattcgatatattaaacttttctcccatgttttcctcatttccgcgcttcgcgctattctttcactgcctcaaaccgcttcgcgatcaaggatgagactccatttatcagaaggacaatgacaagcagcaccactgcagtcgcatttgcttcatttttatgtaaaccttcattagaaagcacatacatatggatggcgagcgtacgcccggaatccataagtcccgccacaccggtcacggtacccgccgtgtagatgagcgctgcggtctctccgacgatacgtccaatcgagagaataataccggatagaattcccgggattgctgccggaagcacaatcttaaaaattgtccgcagttttccggcgcccagtccgaagcttccctctctgtaggaatccggcacacataaaagcgcctcctccgtggttctcataatcgtcggcagcaccatgatggcgagcgtcgccgctccggagagcatggaatagcgccagtgtagtgcaatgttgaaaaacagcataccgaacagaccatagataatggaaggaataccggtcagcgtctccgcagtcagacgaacaacctccacgaatttattgccctttctggcatattcgatcatgtagattgccgcccccacaccaaatggcacggaaaacagcagcgagaccacaaccatctccaccgtgttgatgatggcggggagcatggacacgttgtccgaattataatgtaacgcaaacaggctcggctttaagtacggaatgccgctgatgagaatgtagcccaccaggaaaagcagcgtcaccaccgtgagcgcggctgcaatcagaaccagaagcagcaggatcaaagagccgggatgtctggtataggatttcattttatctttcaatgttactttgttaattggatttatctgctccatcccctactcctttccgcttcgcttgattgccgagaagcacagattgataatcaggataaacgcgaacagcaccacgccggtggcgatcagcgcctcccggtgcagatccgtcgcatagcccatctccatgacaatgttcgtcgtcagtgtgcggacgccctgcagaatactgtttggtactcgcggctggttgcccacaaccatcatgactgccatcgtctctccgagtgcacgtccgacgccgaggatgaccgccgccagaatgccggattttgccgccggtaccacgacggtaaaaacgcttcgctcatgcgttgccccgagcgccagggctccctcgtagtaactctgctccaccgcgcggatcgtcggttcagacgctccgatgatggtcggcaggatcatgattcccagaagaatcgacgcacagagaatactctgtccgttgctgttcttaaaatgttcccggataaacggcacgagcacaaccagtccgaaaaatccgtatacgatagacggaatgcccgcgagcaggttcacgaccggctttaagagcttgtacagtccttccggacagaatcttgccataaatatagatgtcagcacaccgaccggcacaccgatgatcagcgcgcctccggtgacgtagatacttcccagtatcatcgggaagataccgaatttattgtttcccggcttccacttggttccggtcaggaattccacaaatccgattttcttcattgccgggattccgtttgcaaacaggaatatgcagatcagcgccaccgccacgatggagatgaccgcagccagcagaaatacatattccatgatcttctctctttttttcatcagagcctccatttacaggtttttcctaaataacgtgtatgttccacgaaaggaccggaagaacattctgttcccccggtccgtcctgctatgctattttcagctgtccgtcctagtttgctgcatcccaggttgttgtctcgcccgtgaagataccctttacggtgtcggaggagagatcctctaccgggttctcctgatttacgatcactgcgataccgtccatggcgatcttcgttgcggtaagtccttcctctgtctcggaatcctttaactcgcgggaagccataccgatgtcaagtgtgccgtctgctgcgccggtcatacctgtggtagaatcacttgtctgaagctcgatctccacgtttgcattaactgccttgtaagcctcgatcagtttctccattaccggagatacggaagaggaaccgccgactacgactttgccttctgctccgttggactcgaatgctgctgcggaatcatctccgatataaccgttgtcggagattactttctgtccgtcaccgctcatgatgtagttgatgaaatcctgtgcagcctcgctgacctcgccctttgttgcaatattgaacggtcttgcgatcttgtaggtgccgctcttgatgttctctacggtagcctctgctccgtcgatcttcactgcctttaccgtgtcgtttaaggaaccgagagatacataaccgattgcgtaggtatcacctgctaccgatgtgagcataacgtccgtgctgttggtgatgatcgcttcctctgtggtattatccactttctcgccgctctcatctttttcttccacaccgaacagctcgatgaatgctcctcttgtgccggaaccatcctcacgggaatatacggcgattgctgatgtatgatcgaaatctgcattctctgccggtgcagcttcgcttgtggtatctgctgcgtctgcggtggttgctgcatctgtggttgctgctgcatctgtggtggtgtctgctgtatcactgctgccgcatcctgcgaacatgctcgctgccataacacctgtcaataacatacacattactttcttcttcattttgaatcctccattcaattttacggaatttcttctccgttttttcttttacctcgtttcttagaacatggtttactttacgggaggaatgtaaaatgcagaagagcacttatgtaaaacctgtgtaaaaatcctgtcacatcatttcaatctgccggcgcagctctaacatcttattgtccacctttgcgatcacgtccgagtagccgcgcgtctcgcgctccacattggcgatctggccggcatctttcttataacacatctgcgtgtccagctctgcccagtaatccatcgcaaacgagcggatctgaatctccacccggatctccgtgaccgtgtcattgtacgtcaccggaacacccgcaatcacatgaatactctgatagccgctcttcttgggatttttcacataatccttttctttgataatgtgaaaatccttctgcttcttgatgacatccgctatccggtagatgtcgtcacagaaaaagcacacgacccggatgccggcgatgtcattgagtgtctgcaccgcctcctcaaaggagacttcccgccctttctttttgagctttttgatgacgctgtccggcgtcttgatgcggcaggacatattgcgaatgacctggcggtggcattgttccgtcaggtcagcattgatcagtcttaatcgtgcctgtacgagatccatggcggcggcataggatagctgcaccatcggctgtaacagtttctcactcaacaggtcttcattcggcaatttttgttctccgttttgtttttcctttatttctattcgcttctttttctttttagaatcattctttggcaaaacccgctgcgcctcccatcgcaccgctctgtgacgtctcccctgccatgcaccggcgctgcatctggaaacagataaatcccacaacaaacatggcggcgatcgctgccacaccggctcttgacgtatcaaacagctgtgtggtgattcccatcagcatcgttcccataaaggaagctccttttccaaaaatatcgaagatgccgaaatactccgtcgacttttccttcgggatgatcttggcatagtaggaacgggagagcgcctggatggctccctgaaatacaccgacaaacgttgccatcatccagaatttccacgccgcatccagccagagtgcataaactgcaaccacaaagtaagcgccgatgcataccgaaatgagttttgaagatgcaaagcgctgggtcagttttccgaacagaatcgcgcacgggaatgcgacgacctgcgtgagcagcaatgccatcagaaggctggtgtcgctgattccgacgtcttttccgtaggaagtcgccatctcgatgatggtatacacgccatcaatatagaagaaaaacgctgccagaaaccacagcacctttttgtcatcccggatctccgcaaagactttgccgagtctggaaaagatctcgcgcacattggtgccgcccgcttccacatagtatttctgttgatagttccgcagcagcggaagtgtcacaaccacccaccatgccgcgttgataaaaaatgcaatcatcatcgcaaccgtgccggagatgccgatcgcgtccgcgccgaggatcagaccgaggctcgccacaaacggcacgcagcttccgatgtatccccacgcatagccctgggaggacacctcatccatccgctcatccgtcgtgacatccacaagcatggaatcgtagaaaatgagacttccggagaatccgacttttgcaattacgaaaatggcaaggaacagaatccaggtccttggaatcgcaagcgccgcacagccgagcactcccatcatcatgaaaaatgtaaacagcggcttcttgcggttcttattgtcggcgaccgcaccaagcaccggtcctaaaaccgccacgatcagcgtggagatcgagatggcgtagcttagatatgcggtggagtccgatgcgctgatgccgtttgcagacgccatgtttttgtaatagatcggtataatcgtcgacaccagcagtgtgaacgccgaatttccgacatcatacagtacccagaatttttcgagtctgctcattttcgttttcataatcttttacctcttcttccttaataaagcggaatatttcatcataatatttcgcacgcgtccgctcatccgcattaaaaatctcatgtctggaatccggcataaagaaaagctttgtccgctccgtctcctccgcaaaccgcgcgatcgcatcgttatccaccatgtggtcacgacctgctgcaaaaagcagcaccggcaccttgatctttgccagattctcccgccgcatcagcttacggctggcgcgaagccctgcgcggacccaggcataacttccgccgtaggtgcggtaatgttcatctaagagccgcttttgaaacatatagtcataacgctcttttgaaaggcagctgctcccctcaaactgcggcgtctctgaaaagccctgctgtcccgccagtgtggcaaagcattttccttttccggtcagacagcagaactccgccagcagttttgccagaaaccgcggatattttccggtctgcatggcacacatcggcgcggagaggactgccgcctcaaacaactgcggataacgttccagtgcaaggattgcaatggcgcctcccatcgaatgtgcaaacacgatccggtgttcctccccgggacttacgaccgtctccacaaaccgcgcgagatctgcggcatagcagtcataactttgcacatgcaccagttccgggtcatccacctcgcgcccggaatacccgtgtccccggtgttccggcacatagaccgagtatcccgcctgcagaaaacggtatgcgacttcgttatatttttccgcgaattcgcaaaacccgtgggaaatcacaacacatttccccgcatccggcagaaaatagcgccggtaagcgatcgacatgccatcttccatcttaagatagcccttctcgccgtgctctttcagataaggctctaccgtctccgccatccagacggcataagcagtcttctcctctttcgcacagcttctatcctccggcatcatccctgcttcccctgcttctttatcacgcgcaccagctccggtgtcagcgttccgtccagatactcggcagcgatccgcctgcccacgtccggataattcgtaatcatggcgtccacctgcatctcgcacaccatgcgcatgtactgctcctcgttcaccgtccagacgtgtacgcgctttccgtgcttcttacagtcttccatgtaattcggatactgcagattgtagagcgccggatgcatggcgtctgcgcccacgacaagcgcgccatagctgaccggattgacaatgccgtcacagtagagcatgccggtcttcgcctgcggattcagctccttgatgcgctgcaccgtgtagtggttaaacgacgagtaccacacgcgctcctccagtcccatgcgggcggtcaggtcaagcacgcgctcttcgatctccggataaaagaccacgccggtcttcaattccacattgatcgtaagtcccgtcggctttaacagctcatagacttcctcaagcgtcgggatcatcgcccgctcgtacccttccttatgcgtccggttgtaattaaatctggaaattctcgcgtatgtaaaatctttgacccagccgctgccgtcgctggtacggtcaaccgtctcgtcgtggatgacaaccagttctccatcctttgtgagctgtacatccagctccacgccgtccgcgcccatctcaaccgctttccggaatgcctccagtgtattttcaggcgcgtagccgcttgcgccgcggtgcgcccataccaatgtctgtttttccatgtatacaaaaacctccgatatgatagcttcttatttcttctatcatatcggaggtttgtaaaattgttcgggtgcgttgtgtaaaatttagaagggatatgtaaaatatctgtaagatcaccctaactgggaaaaatgccggtcagcattttccccgctttatcattccgcgcagaatctgtgcggctccgccgccgtttccttttttatattcctgcccccgcaggtagagctgcttcactttgacggaagccagttcctccttcgggatgtcgtaaggattgcggtccagcaacaccatgtccgctatttttcccgcttccagacttccgcgctccctctcatcaaaggtcgtgtaatatccgttgtaggtacacatgcgcagcgcctgctgcacggagatggattctgccggattgctgtgattgcatgccttatacatccataaaagcgggtccggatctgtgcagggtccgtccgatcccgcacttaaaatcagtccgtgttcgcagaatgtgcggatcggattcagcctgcccgcacgctctccaaggatctgctccagatagctgtccggctcctgcggccagtcaatgaacaccgtctgcactgccagattgatgtgataccgctcacagaccgcaatctcctccgcagtcggcagacatgcatggatgatcgtatgtctgtgatcttctctgggcagatcgtcaagcgccgccttgatggcacgcaccgcctgcacaaacgccttatcgccgatcgcgtgcatctcgatctgcagaccggcgcggtttgccgccttacagaattccgtcactttttcatccgaatagtagagtacgccgcagtccgacgtgttttcatacggcgagagcagtgccgcatccatggaaccgaagcatccgtcaagcgctgtctcaaaacagcccccgattctcggaagcttccgctttaccgccttattcacatcgagcgtctgcataaacacgcgcatctgcatgccgtttgtgatgccgcgcgcaaaaaaacgctccagatcgacgtccagatctctcgcaaagccgacgccgctgaccgtatggatcatgccgatgccgcgcgcagccagatcgtccagcgccttctgcatgtgcgccaccagctgcaccgtagagagcgaagctgtgatataatccgagacggcgaaaaatgcctcctggttcatctccccggtatcctcatgaaaaccgcgcagatgctgcaccttgccgcgcacttcgtttaacagcaccgtgttgacgacacacgcgtgaccgtcgtactttaccagaaagagcggtttgtcgggacacacctcatccagctgcaccctgcgcaccagatgtccgtctgacacggaatacggcgatgcgccaaacccgatcaccagcttttccttcgttttcttcacatgctcccggagcatctgaagaatctcctcattgctctgcgcattcatgacattgagcccggcatgaaacgtcgcgtaacttgcgaaatggatatgactgtccacaaacggcggaatcaatgccccctccccggtggacacgcgctccgccgccacacagccggccggcagcacgtccccacagtaaaggattttcccctgatcctccaacagataatgtgcaatccggttctctttgtcacaggttaaaatgttaccctcataaagtctcataccgtgctcctttccaatcccttaaattttaaaataagaccggaataatgtaaatgccaagtgctatcaccgtcacaagaatcgtgccggctttccagatccggtactccttgtccatctttgccttttcctgggggacggctcctcgaggataccgatctcctcctcgatggacggaatcttattctcatgctttctggtgaaaagcgcccagtagacaatcgccgccacagtcacaaccgccgccgtcagaagcgctatgcggtctgcaaaaatcagaataatggtgtaggctgcgatcgtgacatagcatccgaccgttcctgccggcgccctgtacggccggttcatatccggatagtgcttctttaagccaaggtaagccagacagccgatcatataacataccgcgagtgagatcagcgataccgacgcgatataattgatcgacccggttgcaatcaggataatattgatgatgccgaccacaagaaccgccatatacggcgtcttatacttcggatgtaccttgcacaaaaacttcggcagggaaccgtcctccgccatcgtgtaaatgtagcgcgccggtgcggcaattcccggattgatggtggagagatcgccgccgaatgcaatgccgatgcagagcagaatgatcggaaagcccaccagtccggccgcccggagtccctccgcatacggtgcgtctgccactgcaaggatgtggtaaaactcgtgcggcaccagtccggcaagaaaccactggaataacgcgttgactgcaaatacaaggaataccgatacttttaacgctctcggaagcgtatactgcggatatttcgtctccgcccccatcgatacacaggtctcaaatccggtataacaccaccataccagcccgaaaatgtacatcatttccttaaacggcggcagggaatccatggcaatcccgccgaaatagtccaggtggatgcgcggtatcatatataagaaccatgccacggcacagccccagaagaagaaaatgaatcccgtctgcgcttttccggacatctcaattccccggaagtttaagatcaggaaaaacaggaccagaacaatcgcaatgatccgcgaatccacgccctcgatattgatgccgagttctccaaacagaattttaaaataattggaaaatgccagtgtctcacccgcaccgatgccgaccacagaaatgatgtaatgccagcctgccaggttcgcccagacccggttgagtccgcgcttcgcataattgtaagtacctccggcacacggaagtgccgccgacatctcgccgtagatcagacagggccagatcgagatgagcagggataaaaatgtaattacaataatccccgatccgacatatccaatctgtgaggaaccacaggtaaacagtcccactcctactaccgttcctatcgtcatactgatcgactctttcagtccgagagcacgcaccagctgacctccttcgtttttctccataacgtatcctcctttgtctgtcttgctgctcctatagaaaaagagcacagacgtcccgcctgtgctccttcgcaaccatgtctttattctgcttttgaaaattctacaccgctttttttcttttccaggatctgtgcgatcagatccgcaatatgtgcggctgcctccaccggcggcacaccgtgcctgctgatattcgatacgaccgtatactccgactcaagcatgtccggtctcgcatggtaggcgatatatgccgacatgctctccgacgtcagaagacccgggcgctctccgatgagcacgcaggtcacctccgcatccaggagcggtccgatcgtccgcgcggtattcactctgcaataccgcacgaaaaacggcgtcccgacggtaattcccttatcctccagacccatttttatggttggaaacagatccggaatgttcgccttgatggacggcgagcacagaccgtcgccaaaataaatctgaacctgcggatggtgaatgcagttttccgcaattttttgtctggcatccggcaaaaactccctgccccagtccgggcggagaagcatttcgtttttattggaacatcttgtccgcacctcaaaaacgccaagttcctttaccacttcctttggcacttcattgaacaccgcgtcgtttgccgccgcatgcgccgccagaaaccggagctgtgcctcggtcgtatagcgtgcgccgcaccgtccgatcccgatccgcgcgggcgtcgcatgcttcatcttccagagttccttttcattgtgcgggtgctccacctgcatatattccataatgtctgtctctgtaatatcgcggaggcaggcggtctctttttcactcataaatcccgttcctcctatttaaagaatatggacgggtctccggcgttcggaccgagatgcccgttttcccagatgccccgtttttcaagccatgctttaaactccggtatcggctcctttttcagcagctgccggatactcgccacatcgtgatagctggtggactgatacatcagcataatatcatccgcctgcggcagtcccatcacatagtgaacgcccgccgttcccagaagtgtcaggatcgtctccgagtcgttctgatcggtcggcatgtggttcgtataacatacgtcgcatcccatcggcagtccgtgcagatgcccacagaagacgtcctcgagcgccgccctcgtgagctgcttggtgtcgtagatatactccggtcccatgaaacctaccaccgtgttcaccagaaacgggtgatagtgccgtgccagaccgtaacatctgcattccatcgtctgctgatcgctgccaaacgccgccgaggatgacagttccgaaccctgcccggtctcaaaatacatgacgttgggaccctttgccggtccctcctcccgaaacagcatctccgcctccgacagcatcccggtattgatgccaaacgccgagagcgccgcctccgatcccgcaatcgactggaaacacagatcggcgcttccctgcccggttctaagcgcttccatctgtgttgtcacatgtgagagcacacaggtctgtgtcggaatctcatatttatcccggatgtccccgagcactttccagatcgcaagtgtgctgtccaccgtatcaattgccggattcagtccgatgacggcgtcaccgatgccgtagctgagtccctctaaggtgctggctgccacgccttccacatcatccaccggatgattgggctgcagtctcgacgcaagcacgttttccgtgccgatcgtggtattgcaggtcgccgtcacccggatcttgcttccggcaagaatcagatccatattgctcataatcttggaaatcccggcaatcacttcgctggtcattccccggcttgcgcgcatcagcgccccgctgtctgtggcgtcacagagaatccactcccgcatctcctggatcgttctgtccttgatcgtgccgtagaccgtttcatcgatatcatcctgaatgatccgcgtcaccgcatcctcctcgtagggcactacaggatgctctgttaaatctgccacggtcagctgcgccagcacctccttggcggcaatccgctctaaggcgctctccgccccgacgcctgccagctcgtctcccgattttttctcgctcgcctttgccagcacatcttttacatccttaaattcataggtctgccccagcatccgtgtctttaatatcataagctgctcctaaccattaaatatcaatgtctttactatcacgggaatgacgttacccgatgcaaccggttcgcccagatcaataaaatctccgctcccgcagctgattccatcgatgcagataacgctgcacttctctttcagtctgtgatgcagcgcctgcccgattgcttttccgatatcctcctcaagcaccaggatcagatgcctgtccatgccgcactccctgacatactggtctgcaatcagttctgctattctttgtacctgtgcgaaagtagggcactttaaccccttcatggcaagcgccacctgccggtctttttcctgatcctcccggtaaagcagaagcgcccggtgcatgttttccggcagtttttcaatctcttcctcacgctccagtggaagcttcaccaccggaatattttttaacggaaacggtttcgtcgtgtactcaatcgtacttccggaaatgttcatgctgtagtttcctgcgccgatcaccgtcgcccgcatggtttcccgcgcatccgtcactgccgcccggcgaaacgcttcgttcttccggatcgcctgcgccaaaaggattccgatgtccccatagcggaacagatcctcctcttccccgaagcatgccgccaccccgccggagaacatcacaatatcggacggcgtgccatccgccagaagatggttggtctgcatgtaggaaagctctgctgcctccggcgccagatgcactgcctccgcaagaagttccgccatcgcagcggtgagtctgcgcagcttttccggttctgccgtcccgccctccgcaagatcaatctcaagcctgccgcacagccattgcagctttggcgccatgtagatcactctgccgtccttcacgcggatcagtctgccgccgatgtcgaggcatgccgtatcaaccatatttccgtcctcaaagacacagatatttgtcgtgccgccgccgatatccagattgactacccgcttccccgtcttttgggacaaatctgcggctcccgcaccttttcctgccaaaacagactccagatccgctcccgctgtcgccacgacaaactctcccgccacgtcggcaatcgcccgtactaccgactcggcatttcttttccgggaagtctcccccgtgatgatgacggctccggttgcaagatctgccggacaaacgcccgccttctcatactccttttttataatctcatgcacgcgctccccatcaatctcctcccgggatgacagcggtgtaaaataaatctcactctcgtaaatgacctccttggacactaccttgatctgtggaattctgccaaatccgcctgtgttctggagaatcatcctgctgaacacaagctgcgtcgtcgacgttccaatatcaattccggcacttaaaatctcttccgtctgcattcttctcctcctccaaaaactgttcttttttgtctgtgtctgccgctcaccatataattgcgcggtggttttttatctgcggcagcccggcttttacatcttagtgcaatctggtatttcctatggaataaataagaaccctgcctgcaggattctccgcctgcggcgggtcgctcttgcgacatctttcgtctccgccgcagtgcgcatccccggggagcttttttatgtaataggaacgaagtttcctaattacaaaaaaaaagagagcagccgctaccgcggtgctcccttgcacatgtcatctgatatctgaatttagaagttattatagcatgacactttttgttcagcaatttccttttttaacaaatattttaccggctgctcatatatttttgtcttttttgtaccttttgtatgacttcttccagcctttttgtacggattcaggcagcgttttttgcctgccttacattgtagaccgttgccgaaccaaccaccagcagggcaccgataacagcggttgcaccgattgtctccccataaaaaacagccaccagaaccggatttaagattggctcgatcgtcgaggtcagagacgctgtgaccggagagactgcatccagtccccgcgacaggaacacataggacagaccgaactgtaccacgccgagcagcagcacgaagaaccagatatgcagtgacatttcgctctcctgcccgtaaaacgggattccgatcgccgcgctcagcgcacaggacaccagaagcgacgattcaaagtccgctccgcggaattttttctgcatcatcacaagcgcataggcaagacctgagagaatcgcgagcagattccccgccatggctccggcatccagcgacgtataaaagaagcagaaaatcccggcaaagactcccgcgcaggcaaacaccgcatcccgccccggctttttgtgaaagatcagccacatcagaagaatgacaaacaccggctccgtgaactgcagcacaatcgcgttggcggctgtcgtgagcttggtcgccgccacaaaggcaaacgccatcaccgtattgcacaccgcgccgaagaacaccgtcttattccacacgaacttctggcggcgcagaagcatgtaacatcccacaaccagcgccgagaagatactgcgcgctccctggatcgtcaccgacgaccacgggatcgatttgattaaaacgcctccggtgctgaaacagactgccgatagcagcacgcagactgttcccctcaggctttccacattcatttttctatcactcatatccatttctcccatccgggtttctgtcgtattctccatccgcgcttctgccgtattctcccatccgtgcatccgccgcttcctatgaaatgaaaacatagaccagcacaagtactgccagaaacagtacgtttgcgatcgtaaaccacaggaggtagtgccctttcgtcttattataattgtgcgcgtagatcttataagagatcaggctcgccatcgacgcgatgagcgttcccagtccgcccagattcacgccgatcgcaagatttttcagatcgtgcgtaaaatccgccagaagcagagctgcaggaacattgctgatgatctggctcgccccgatgccaaccgccagttccctgcccgccacaagactttgcaggacagaccgtaccgcctcgatattccccatattgccgatgaagatgaagaaactgataaacgtaaacagcagacagtaatccacctgcaaaaacaccgcacgatccgtaaaaatgagcacaatgagcaccacggcgagcatcagctcccacggaagcacccgcgctaccgaaaacaggcttaatgcaaagagcgccagataaatcccgtttttcttcctgccggatgcgctggacacctgcaaaagcgaaccggtctccagcgagatccggcattttcccgcactgagcacgaacacgacaagcagcagaagcacacctgacacgagcgtatacggcgccatccatccgataaattcacccagcccggcaccggagatgctgtaaagatacagattctgcggattcccgaccggcgtcagcatgctccccagattcgctgcaagcgtctgcagcacaaacgttgtcacaatcagccgctcctggtggcatttctgcaggatcgtgcacgcaaacggcacaaacgtcagaagtgcgacgtcgtttgtgataaacatactggaaaaaaagcacaaaaaaacaagcaccagcatcagctgcgcggtatttttggtctttgccagaagccggctgccgatcgcatcgaacagtccgttgctctgaaatcctgccacaatcagcatcagcgacagcaaaatgccgagcacgcgccagtcaatgtagcccacgtactgcggacccgggtgcacccagaatgccgatgccacagcgaaggctgtggcgatcgtgagtaccgtttctttttttataaaatctgtgatcttctgcaacatgttgtccatcatcttttctgtttcattgtaaaaattcctttcctattttacttctcttttttgcacttgcataggatttttttctgaaaatgcggcatactaccacaagatagcctgttatcgctgtatgcgcacagccggtgcctgtcattttcccatgcacagctgcccgcgcaggaatggagatttacgtgaaaaatacattatccttacctgtcacaaatgaaaacggctcctatgagatccgcctggagagcatcggcgggctgggcgccaatctctgcggaaaaatgctcggggagctcggcgcactgtcgctttcgctcaattccttaagcttttccagctacggctccgaaaagcgcggttcaccggtcaaggcgtatgtccgctggtgcgccgatgaccgcccgctgcgcgtcaacagccccgtgacccggccgcatctgcttggcatctttcacgggggactgatcggcacctacccggtcttggagggcgtcaccgtagacaccaaaatcgtattaaatacccccttgtccgctgacgaggcggcagataaataccatatttccatcggagaactctattgtctggatgcgctcgtacttgcgatggaaagtcattcccgcatcaacatggtcatgctcggtgctctggtgcgcgccagcggatttatcccgccggaagctgccgaaacgctctgccgcgatacgatcgggaaaaaatatcccgcactcatcgaagccaatctcgcgggtctgcgcctgggatatgaaaatgtcaaaatggctcagggcgaccgcaacctcgcccctctgccggacgccccggcggaccggtatgcttggggctatgccaacgctccgatcggcggcgtcaatccgcggatcggaagcaccgtctccaacgatctgaccgcctcgcgcgaagggtacattcccctttttattcaggaaaaatgtatcaactgcggactgtgtgacacggcatgcccggatatggtcttccagtttgctcccggcacctaccgcggaaaaaactgcatggtcaaccgggggcttgactactatcactgcaagggctgcctgcgctgtgtggaagtctgccccaccggcgcactcgtgccggcactcgaaaaagattacccggaaaaaccgcattttcttccgaatcagcatctgctgcccgacgccatccgctatcagaccgtcggtgcgaattcctggatcacaagcgattcttttaccgacgaaaagcgggtcgacggaggcgtcgtataaatgcaggcagcacccgtgaatcgtaccggcgcacagcgtctgcagaatggagaatgatatggaaaaacaaaaaattatgtatgacagcggcaatgagcttgctgcatttgccgcaaagcagatcaactatcacgtcatggggtattatccgatcacgccctctacacagattgcggaaaatctggatgtcatgggcgcggaggggcttcacgacattgccctgatcgccgccgagggagaacacagcgccgccggcatctgctacggcgcctcagccgctggaggccgtgtatttaatgccaccagcgccaacgggcttttgtacgccttagaacagtttccggtgcagtccggcacacgcatgccgatggtcatgaatgttgcatgccgcacggtttccggccctttgtgcatcaaaggcgatcacagcgacgtcatgtatctgctcaacaccggctggatcattctttttgccgatgaaccgcagaaagtctatgattttaacctgctcggtctaaagcttgccgaggctgtccgtctcccggtcgcagtcgcgttcgacggcttttttacgagccatcagaagcgcaagtgccttgtatttgagaatgatgacaccgtcacccgctatatcggggaaaagctttcctgtgacaacccgaaggtctccgcatttgccggcaccggcacctgcggcaccgccgcagagcttccctacgccagcgtcttagatctcgcgcatccggtttccatcggttcctatatgaacgagccggatgtcatcaataaccgctaccagctccatctcgccatggaagccgcgagaaacaagctgccggagctgtttacggaatatgctgccctctccggcagggaactttccctctgcggtgcctaccggcacgaggacgccgaggtgctgctctttgtgctcggttcctcctaccacaccgccatggaagccgtcgaccggctgcggcaggacggcgtagcggcaggcgtgatcaccctctacgttctgcgcccgttccccgctaaggaacttcgcgtcctctgccacaatgctttcacgattcttgttgcagaccggcaggacagctacggcgccgggggcggcaacatgtcgcttgaattaaaggccgctctctcttccctgccgcacccgccgcgcattttaagccggatctacggtctcggcggcaaggactttttcgtggaggacgcccttgccctctttaaagaggcactctcgccggacgctccggcgttcgattactacggcgtcactgcgggcacggaagcttcggatgaggagacttcaggcacttccggcagagctgacccggcgatggcggtttctgcgatgcagccgcaatattttaagcctgtcacaaaggaagaatccacaccgggtcttaccacctgcaccttcgatcccacaaccggggaaatgaaagtctccggcggctccgtaaaagatacgaccgccatgccgatgcgcgtcgcaccgggacacggtgcctgcccgggctgcggcattccgatcaatgtgaacctcctgttaaagggcatcgagggaaatgtcgtcctgctgtttcagaccggctgcggcatggtagtgacaaccggctaccccaaaaccgcgttccgcgttccatttctgcacaatctgtttcagaacggcgcggcgaccctaagcggcgttgtggaggcgtttcaccagcgccagaagcgcggggaatatccggacggcgagattacctttgtgatggtgagcggtgacggcggcatggatatcggtatgggatcggcactcggcaccgccctgcgcggtcataagctgatcatttttgagtacgataacggcggctacatgaataccggctaccagctctcctactccacaccgctcggcgcaaagagttctacttcccatgtcggaaagacgcagtacggcaagaacttcttccacaaggacacaccggagctgatggccgcaacccacattccctatgtcgccacggtcgcagaatcgaatccgaccgattttatccggaaagcggcaaaagccgccgcctattccagggagtttggcactgcctatatcaaggcgctgtccgcctgtccgttaaactggaatgataagcccaatctggagcggagcgtcattgctgccgccgtagactgctgttattttccgctctacgaaattgagcgtggtatcacagcgctgaattatgatcctgcttcgagcaataagaaaatccctgtcacagaatggctgggtatgatgggacgcaccaggcatctgctgaaggaggagtaccgctccgtggccgaagagatccaaaaagagatcgaccggcgctacgcccgtcttagagcgcgtgccgagcatccgcttctgtaggcacacagagagaatccggtcggcgggatgctgtgtccggaagctcatagccagaccggtaattaaaaaggacaggaatttcttcctgccgcgctccccatatcattccatgtctcttgccacgctttgacactctgcggacacacccgcggagcgctcaaagcccagatagacacggagcatcacaaatcaaaaggcaaaaggaaattcgaactcttctcctacagaaaatggaaattccccgtatatttccgtaactttaaaacttgcgccattccatccgtcgattttgatcattccttttacacttccgtcttctgatgtaaagctcagttctccatttccatgatccacaaagcttccttccatttccccctgtctgtaaatagagatcaccgcttcatcttttccttcccaattctgtctgatgatcagggaactgtatatatcaccggttccctgattatctacaaaggttccgtactttgcggaaacttccggcataacaaagtcttcctcttttatcttcgccagctctcttgcaagaacatacgccctgttttttgtaatttcctccagataagagtcctgtaaaagcggatacatactaccattttcttctctggaaccaatatttaataaagtcacttcttctttcagatctatccagtttctctgctctgccagaagattctccttcatctgccggtccgctgaactactcaatctgccccaaagattattcagttccgtatcccatatcgtataaagccattgcgcggctacattcatttcgccctgcgtttgtgccgcctcagctaatggggtatacttttgtgtaaccttctccatattcgtcaattcttcctgcagagatgtggaatccgctactacatcgtctacatcttccttaatattctcagaataatcgcgggtaaagtctattttcagtccatcctccaaatgaatctcatcgttttcactgttctcaggtgtagtttgttcttccatgcgggaattttcgatttctgtattctctttaccacatccggtataaattcccatgcttaacactaataccagcagatagattgcttttttcatatattacctctccccatattttcttttcttcatcctgtgtttccattcgctctgcaaactggaagttttgcatacgttattcttctaatatttttgtagggttcgcatccgttacaaatatcatactatcataaagcaccgcaggaggttgaaacattcgataacttggaggaagaagtcgcataatgattgagtagctttctccaagtgttcccatataggtgtattcagaagcctgcctacctagttcagaattttccgggactttagtaaaatccaaccaacaaatatcaaatcccgccagttttgccgcctttgctaaagggtcatgggaataaaacacctgaattgtacgcttttcaggcgaacgggtcggcatattgcaatgggttttataaaaatcggtaccaatgacatagtaaccatttgctgcgtccttggaaagaagtttacccatcgagtcagaactgccccattttgcgacatggctgttgtgacctgtcacaaagattttttcatgcccatttcgctgctcctgctgtaaaatccactgtacattttctgccataaattgatctcttaatgtagcaccatcagcatttgtcagagtttgaagctcggaatgctgcattaaaatatctacaaagtgaattgcattttccgaaccgttcttgctttccaattctttcttcacttgcgtaagggtttcaattcgagtagataaatcgcattcactgctccagttttcaccttccacaagtttctgcaagtttgttgtgtccacttccagttctttacaggattctttcaaaaacctcatgctgtaagaaatcctctgcatatcaaaaccgtaaaagcgaaggtcttcgccttccaatgcactttcattgtactggcgcatataggagataagttctgccatctcttccgttctataaatggaaaatccaatcgctgcggctgcttcctgtgctgtcccctcaccgccgtgtatatatcggtttacctgctcgcagccgccgtagtcaccttcaagggcaaacgccctaacaccattattttttaccatctgcttgaacacttccagcttcaactgctgaaattctgcatttccgtgagtagcttctcccaatgcaattatttttgcactttcaggcacagttatattttccacgggttcagcataagctaaaaactcttctggattcacattttttcctgtgccaaaacctccaaaacgcataaatacaagtgccgctaaagccataacacctaataatccaaaaacgatatatcttatcttaaatcttcttgtcttcttattcttcatatctgatagccctttataatgaatcagttgtcttacatccgttttccacgcttattgtacttcacgtaatagttcttctgccgtagtgttgaacaattttgcaagtgtaagcagattggaagtgcttgggtcagatgctccggtctcccatttagagacagcctgcctgcttacgccgatagattctgcaacaaactcctgcgtcatcttacactcttcacgatgctgcttcaaaacctcaccgagagatttcttgatgctggacttttcttttctgacattgcctgatttgacatatctactcaatgctcttatgaggaaaattcccacagtgataaatgccgctatcaccgccaccccgattagcagtacaataccaaaaacaataactcctaaaaaatcatatttcacttaattacctcctttcgtgacttcatgatagcgaaatttcatggttgctaccaccaactatcacgatatttctttggttgcgaacggttgcggaactaaaataacacttttttatgtaaaaggcatatatgtaaattaataaaacaacaaatccggatttttaaacggttttaccataccatatctgactggctattacaataactgcccagccccgcttactatacgccacctgttgtctaacaaaacataaccgcgcgaagccgatgtctgagtcggcatctaccctgttttcaatagcagatgccggcgagttcggttcgcgcggttttatattgtctgtgaaacggagagccaccaggggctctcttcccatagccgcagagacggcgcgctagttctgcttcctcctgcgctccatacgtgtctctgcaacgtaaagtacaagatatgccaccgccgcatacaaaagcgtgagtaccatcacagcaatattcggtccgatggcagctggatctgaaagagaatgaagtaatgccggaaccatgatgaccataaccaccagaccggcgggcagcactgttttccttaagaaatgaaccacctcatattttgtccggcagccactgaaaagcacgcacgccgcacagatacatactataaggatgatggacgggcaatccacataccacccgatcttcgcctgcgacaaaccaaatgtcagaaagactgccactgcgagcaatgcgattcccaccagcccctgccatctgcctgcatttttattattctgattctcctgcattaaatgtttcatattttcttccgcctttccaagatattcttcggaaggaagcttctcacccgacagaagttcgtttacattgatgtccagcacctcacagagcggcgacagatatgctatgtccggcatcccgttcccggtctcccacttggataccgtcttgtcactgatgccaatctgttctgccagttctttctgcgtcaaacctttttcctttctcaatactgcgataaatgttccgatcctcgtctgatccatatacttcctccattttccgaacaggtcgctgtccaccgttccgagggacctgtcatgcttttgtaaagctgcagctttatagctacaccttagttcaccgacccgtaaagtgcaatcccttcaccgtagaatacgctctataaagcaaagaaagccgcgtagattatctccctgcgcggctttttctcctactccatatattcctgcaccagcgtcttatactgctgcaccttattggcaatcccgccctgattgtagcggtcgacttccgccgtcaccgtaatctgcatcttgcggtcttttccaagcatcttattgccggaaagatcctgtgtgatctccggcataatcagcgtaatctgatattcaatgcttcgcagaatctgattctcatcgatcacataggtcgccgtcatatcctcgtaatgtgcctgcttgtgctgctggacggatagcgccgccgtcttcacggcgttctcgtctgccccgcttttttcataaaaagcataggacttctccacctgtgccacctgattctcccatgcctcctctaaatattcctgcgtaaaagagcaggtaatctccacagccccgtcctctgtgacacgctccaggtcttccacatctgtcccgtcgtaacccagatctgtcaccatttcataatcaggaatgacggtgttctcccgctgctgtggcagtatctgctcccactcaccactccagtcaatgtaatgatacagattcctcccgtcacagaactgctttaaatagagtcttgtcccgtcctcatccgtcgtgtagtgttcgcttatccagtcacctgtcagcatatccgcccaggcatgcatcgtctctcctccggcgcttccgttctgcttccagcgatattcataggaaagctgcagattgtccacttttcccaaattccacatggcaacctgaatctctccgagttctcctcttcccgtactgttctgacgcagtgcgccaaatatcagcacaccggcaaatacaacgactgtcagtatccgcagctttcttttttccatagcactatcctctatgccagcaatcccaatgtttcaaatgcccgataaattccatcgtcgtcgatggacgatgtaaccatgtccgcccgttccttgacttcttctcgcgcgttgcccatcgcaataccgattcctgcgtattccatcatctgaagatcattcggaccgtctcccacggcaatggaatcctctctcgcaatgccggccgccttcagatatcgctccatgccggttgccttattgattccgttgatgccgatctcgcccgcatattctcccataccttccaggctgatcgccaccgtgtcaaagtaaggctccagatctgcatgtaccttcgccaccggaaacggcgcattataatatagaagcttttcatttctcggattcttccaaggctcttctgtcagatgcatatttccggtcagacgcacaaggcgctcctcgctcatccccatctttcggtagatctctaagattccttcactgctgcggcggttcaacaccacaccgtcgtccgcctgatagcaaaacaggaatccgttgccctccagataatcgtaaacgctcttcctgtgctcttcatcaatatatgcgtgataaatttccttcccatcggcgatcacaaacacgcctgccgcgccgacaatcccggaaaacccaagttccagcagctcatcataaatctggaaacggcttcttcccgtacagacgaccatcttgtgaccgttcgccttcgccctgcggaccgcctctttggtagattccggtatctctccccggtcattgaccatcgtgccgtccacatccagaaacaccacttttttatggttatttatcatttctgcgctcatattttcctgtcctcttcacgattgcttttatgtacatgatatgttgttttggggatggaatcaagctattttaaacgttatatggaaaaaaagtatctttattttttcgactcccaccttacctgtccttcatatagccgccggatcggctgctgttcttgcacccgatcgtatatttatcaatgatcgtggcatcatagaaactctgctgtgcttcctgtatcaatttatctgctataattattttttctatatttcagcggtgataccgcatatgccttctggaaacttctgataaaatagcttacattctgatacccgctctgcatggctacatccgtaaccgggatatcggtgtcctgtaacagctgctttgcatgctccaaccgcaggtatgttacatattgtgacagtgtaatatgaaaatgttccttaaaatacctcgatatatatttttccgagagatgaaactgttccccaaattccctcagcgatatctttcctgtaaaattctgctgtatataggaaaccatctctttttctactgtatttctgccacttgtatcattttctattacaaatcctttcttccacatttcaagaataaattgtaaaagaattatttttgtcctgacctgtgtcgttattttcgattcactttcatccttttttgcctcatatatctcaatcagctgttcacacagttcttttgctgtatcctttactcttggacatatcatcaagtgaccgctatttaatggttcaagcaatttttcatctaacatgtcatctgtacgaaaagatatatactttaacggaaataggaaggtataataatccacagtaccggtctgtgatcccataagatgcagattgcccggcgacaccacaaacgcatctcctgtttttccaatatagctctctccggatatacttaccgccagaaaaccgcttcttacatatataatttcaaattcatcatgccaatgtaccggtatctgaaatgagcgccccgcattctctatatgatatgtgctaaatggatcgtcctttgtgccatgtggtttgttttccttcaattcaaagtacatattctctcctacagttctacaagactcttacttttccattttccgcttttccatctaaacaccattccaacagctctcgcacactcatccgctgccatggcaatatatgctcctacagcctgaagtcccatatgtattccaagaaaatacgttccgccaactgcaaacaggtacataaatatcgcacccataataaccgggaaaattgcatctccactggtttttaacgcctgtccatatacaagatttgtcacccttccaaactcaagaaatatatctactatcaacagctttaccacaagatttatcatttgtgtgtcatccgtaaatatatgaatgataaaatgtccggacattgcaaatgccgcagagaagcacgttgctgttataagaccatatatcacagcttttcgtgtccccctgtcacattcttcaaactcctttgccccaattctccagccagtcataatagcattggcctgtgcaagtgcagctcctatacagtacgagaaatttgctatctgcatagtatacgaacgtgctgtaacattcattccgtccgcatccatctgattcataaatcgtactatcagtgtcattgccacattataaagcgctgtttctaatgcagaaggaaaacctatcttaacgatctgcgcaagtatcttccgggacggaattcgctccgggctctgctttgcttttataagtaccgcgcccatgcctgctacaatcagtagatttacaacccttgaaataactgtggcagcggcaactcccattactccccagttaaacacaaacaaaaataccgaattaagtattatattaatgagatttccaacaaccgttcctatcagtgagtgctttgtatatccaaacactctcagataactggaataaataggaatcagtgcatttaaaaaacatgcgcctccaacaattttaagatatgtttccgccggttcaaacaaagccggggcaatacttactattctaagtattccaccagaaaaaacagcaagaataacagacatcaggatgcccatcactgcattaaacatcagtccaagctgtctggcctgatatgcaactccaggtcttcccgctccgatattttgtgacataaccgctaccatacctgatgatattacgccgaacatgatgataaaaacgcctatatatgtatttgctgttccaacagctcccacagcctggtcacttacagatgataacataagtgtatcaaccatgcctgaaagcatataaaataaagtctctacacatattggcacaaatagctgtgtcaatgtttttctttcagctgccatattttctcctcagatgctccttagatgctaatataatctatattatcaataatacgatatatctgcatatatttcttgtataatatcatgcaaaaattgcactatttctactatgcagtctgtgagaaatctacggagcgtctgacaccgccctcaaacctgctgctttaacctcttcatcacagttttttcgtcaccaaatgtaatctgcaataattttcatcttcaaaaatgacaccttcatcctgaaatccattgctgataaaaaagtccaaatccccatttggaaagacgcctttttcatcggatattgcaaggattcttttatattcgcccgctaaatatttttccagtttcataaggggagcacttttataatcataggctgcatccgtcatgtatacacaagtcagaaacgctatatcatcatcgtgtggaatgtcgtatggaatgaccttcgcaggcaggtattccacaccgccaacgagctctcccttcccgtttttatgaataaaaccatagatatccagctcgtactgttttagaaattctattttctttttacaattttcagacgttttgtccccacagcactcacaggcgatgtcgaacttgtctaaggagagcggctctatgatccctttggtaaaatttctggatattgttggtaaaaaaggtttctcctccggatatattccgtttgctgcctgctccagaaaagacttcctgagcggactatagtatctttttttcttatccagaacaatcagtgtgggaaaaaacatcttcatttcccccgccaataaatgattgttggaaatgtcatatagattgatatctattttatcccgatattcatttaacagccggatcatgttgtcattcaacggacattgatatgaaaaatagtaaaaatcaagtaccatacacccctccatcatctctgattatagaaattttcccacgtcatcacatactccttttcactggtagcttcatccaccccttcacaccggatcgcaaagccttcccgctgataaaaatggatcgcccgtgtgttcttttgatacacatttaagcttagctttgcttttctgtttttcacaaaatccagtaaaagttttccgattccctgcgaccgcatatcatcagaaacgaaaataccctcaatatattcatcatttaatccgatgaatccctgtatctgccgggcatcctcatatacgtaaacctctgcctgtcccaacagttcctttaccagttcaaagttatccctccagtattgagccggaataaaacaatgggcgtttaaattaccctctaaccatatctcggcaactctgcctgtgtattcactctgtaatctgctgatcatcataaatccctttccacgctattcccctaaaagccctgcccgctccagataccacgcctgaaaaccgtcgaacgtcaatcgtttgtccagattttcattcggtctggaagcggattcgataatctcccggcagttcttcgttctgcgcagcatgtcataggttaagcggtaacacacttttaaaaggaatctgctaccatcccagatccagcagccagttattcagtcctctttcccgttccttttcgtcggtaatatttttcaaattggtatactcccctttgatattgccgtctacgataaagaggactctgccgcattttgcggcaactttcgcatcatgcgtcaccatgacaatcgttgtcccctcgccgtttaacttcacaagttcatccataacctcattggaggatgtgcggttcaatgcacctgtcggctcatccgcaaacaacagtctggggcggttcatcatacttctgcatatacatgcccgctgaagctgtccgccggacacctcgttcatatcattatctgcaatttcgataattccgagcttacgcatcagctgctcgcctcttgcctgcttctcttccctgctctcctttgatttcctgctttccactgccgggagcacgatgttatccagaatcgtcagattcttcatcatatacatctgttgaaaaatgaatcccatttcatccagacggagctttgccagatctttttctccaagcttcgtcagatcctgcccctcaaagagcacctgtccgctcgttgcccggtccatgcccgaaatggcatacaaaagtgtagattttccggagccggacggtcccatgatcgccaccatctccccctcatttacctcaagatttacattttttaatacgttattctgccttttatcaattacatatgttttgcaaagatcctttgcacaaagtaatgctgccatatgatgttcctccattttatttttactctatatttgcagtatcgctgctcttaattgtccggatctgcaatgccgtgattcccgatgccagaagcgtcataaggaaaatgattcccggatacaacaggaaaatcttccacgtgttgatgacataagaaacctctaccgcccccatcatgccaaaaatcggatttccaatcagatacgttgcaggaatggaacagattcccgccagaaataccgccgcaagcgtgactatgccaaaccggatcacatgccatcttatcactctgctatttgaaaagccaatcgcctttaaaattgcaatctggcttctctcatctgcaagaaatgactgttccatcagaatacacaccagcagcaccacaatgagtgtaattccaagcagaagatactgtacggattcgatcgttgacgccgctcccatacagtcatcacagtattctgcggcattcattaccttatcattatcaaaaagctgttttatcttatccttgcggatctcaacctcttttgcagacggatgatcggtaaagttaatctgataggacatcagacttgcaatataggaaaaatccgtcggtgcatcctcatgaagccgtatcacggctccaagctgattcatactctggaagtatgccactacgatacaatccagcgtttcggttccaaaatcaattgttaccgtatctcccatttttgcccccgtcagttttgaaatcgtcggtgtgatcgcaatctcgttcctgctctgtgggacaataccttccgtgtattcataatctgacgcaccgacatcaattccctgctcgcagacgatagaataatcgtttccatccacacgcaccttatatttgtactgcgcctccacacacatctttgccggcattccattcgcttccagcagattttccgtatccctgagatagttctcgacccgctctaacccgtccggattcatactgctcatcgcttccgccagatcggtataatacagatcactccgggatccgaatgtcgtgatacatgtgtcactccgcattgttgagatgagattgacaaacaccagcacaaacagggtacagataaaaaatgtaatcacaatcgttgcataccgccgcggcgcactaagcacatcattgactgccagaaacatactcgtgcttccatgacttttccccagccggacagacgattttttcttgtaacgctcccctgtctgaccggagcggattgcatcgataggggaagacttcttcaccaggccggtacaccggaatgcaaaaagaagaatcacaacaatgaccagaaccgctccaagcacagaaagtccaaaatgattgtccgctccaagcacaatgttgttgctgactgaccgtagcatcagattggaaaacggaatactgagcaaaaaccccgcaacagctcctgccactgcgagcatcagatattttgccagatacagactgcgaatcttgaagctgctgattccgattgccttcatcacgccgatttcacggaattcctccgaaatcgtaaatgtaatggagaatttcagtaccacaaaggataccagaatcagacagatactaagaactaacatcgtgaatgccacgatcatatccaagacataacacatttttatcatggaacgcgttccggaaaacataatctccggaaccccggctatcagggatgcaatatcagacaatgaggtatcatctgccagatcaatgtaacagatctgtccctgatatccattgcggatactgtcatcggaaagcagctgctcaatctccgctttgttaaacagaaaacggctgtttcccatcatgctggatccgagcagcgcatcctttgccatgccgtctaacgtcacagaaaacgatacgctatgatgcgtaatggtaatctgatcgcccggcttcagatgattcttttccataaaatctccggttgcataggcatgtcccggttcaatctccgtaatctgctcattgtttttgtcaaaaaatttgagccggctgtcttctacggcctggtagaccaccgagttcttagcctccaattcttttccgtccacatccttgagattggatttgtcgccccagacgaccggctccgtgcggtattctatgaccttctcctccgtacgcagcatctcatccagtgccgccccgctgtccgttcccatagagattacaacataatctccgatgcccgccttatccagataagagtcgattccgttcgtgacagaaacgacattgctgattccgctcgccacaaacattgtcgccagcagaataaaggaaagcataacggcattcatcgccttttttctttttaagtctttcttcaaaatacgaaaaaacatctaatcctccttgttttccgaaggaaaatgcgaaccctctggtgagcagaggattttcctccttgttttcctcacctttatttgatgtactcatcttacaggagaatttattaaacaatccttaaatgtcgttatgccttccgcacaactaccgtcgcacagaaatcatcgtctctgatctctgcatacacttcgccatccatcttatgcatcagctgtctgctgatatacagtccaagtccggaaccatttcccgcttctacattacttccgcggtaaaatgaatcaaatatattcacaagttcctcctgttttaatgtacagccggaatttgtgactgtaatcagccggcagtcctcttcctccgaaaaagaaacaataatccttttcccgtctccgtatttcaatgcattctccaaaagattctgcatcacttcgatcaatcggtctgcatcaccttttagcagacagtccgtatagggttccatctcaaataccgtatgcagactgccgaatttatccatataaagtttcctgattgcttctatcacatctgacagatacacttctgtcagatttacggtcagataaaggaaatcctcccttgatgcaacggtaatctcattcacgtatttctcaatatctgttacattcttctcaattccccgatatgcttccatacgtttatcttcctctgtatacaaaccttccgccaaagcccttgtgtacaggcggatggcggacagcggagtgttaatatcatgcgtcagcgataaaaccagggtctttttctctttttgcagctccagttctttcttcctgttgctctctaacgtatcccgcagcatatccattccccagaggaacctgccgaagaacctgcttttctctgccttgattggcgtagaaaggtttccttttgccagttcctccgtcagattctgcatattctgaaacggtcttatcactttctctccaacgtaacatacgaaaaaaacagacaacaaaaacatgattcccaggacgatatccatgaaaatccatgttccgtagtctgtttgtgtgtaaataattttatagatggtatctgttttttcctgcgctctctcaatacgcggttcccgggtcactgctgccatataatagaacacattcgccgccatgatgaaaaaaagttctatgccaagaacccccgccgccaattttttataatgcttcataccggtatcctgtcccccagaccgtaataatatgttttggatttttcggatcctgctcgattttctcccgcagccatttgatatggacagtaagcgtctgcatctcagactcactgtcgctgccccagatacggttgaacagatattccttcttcaacgtggttcccctgttttctatcaaaagctttaacagctgaaactctttttctgtgacattaaccggcatgccatcgaccgtaagtgtctgtgtaacactgtttaaccgcagatggtcgcagacgatttcatccagtgcatatttccgcttaaaaatcccgttgatcttcgcaagcagaatatcaatatcgtagggtttgctgatatagtcgtccgcgcctatctgcaacccctttaatgtgctctccttatccgttctggcactggcaatcaggatgtgcgtattcgagttctcccggatccttgcgcagacagaaaaaccgtccactcccggcagaccgatgtcgagcaccagcagattagcaccgtaccgttcaaaaatatcaagcgccttttctcccgtgtctgcaaggctgaccgtataattttcttttctgaggaaatcacataaaagcgtacctatttccctgttatcttctacaataataatatccggcataaatcctgtctcacctgctcccgttatttttcactgcttttctgcgcggatttcttctccgcccgggcagctacaccatctgcaccagccatacattgctccgcaccatgcggtatccgatcgccaccttaatcagctcggtcgcctgcaccagaaagtacacgctcacaatgccaagtcctgtaaaacgtgccagtacaaacgcggccggcacgacaacgatccacgtgaaaacagagtcaaacaggaacgtaaccatcgtctttccgcccgatcgcagcgtaaagtacgacgcatggctgaatgaacagaacggcatgatcatcgccgatacggcgatgaagcttgtcgcaagcgccttgatctcctccgttgtattgtagatctgtgggaaaaatcctccgaccaccagcataagacctgccacgatcacgcagcagaacacactgaacacgatcatcttgttgtctgcgtcctttgcttcttccagctcgccggcgcccagatactgtccgaccacgatactgatgcaggaaccaagctgcagatagatgatgttgaacaggtttgtgattgtcgtcgcgatattcagtcctgccacaacctccagtccgcggacggaatagcactgtgtgaccgctgtcatacccgccgcccacagaacctcgttgagcatcagcggaaatcccttcacgataatcgccttcaattcctctcccggaatgccaaatccggtataggcgccctttaaatacaggttctgtccggtatggctgtgcgcccagacaataatgatgaacgcctcaatgtagcgtgcaatcaccgtcgcaagcgcggcgccggcaacaccaagctccgggaacggtccgattccgaagatcagaagataatctaacagcgcattgcttcccacagcgacaaagctcgcaaccatcggcaccatcgtctgtcccgtctccttgatattcgtcgcatacgcctggttgaccgcaaacggaaccagtcccactaccatgatcccaagatactgcagtccatacccaagcgccacatccgtcgccccgtctccggcggtatccgtcagataaagcgagatcagattgtccccgcatgttagaaacagcagaatggtaagccccgtcacaagcagcgccgcatatagcttaaagcggaaggaatacatatgtcccttgtgattcctcttgccgtaatactgcgccccgaaaatactggctgccgaaaccgcgccgaaaatcgccagattgtatacaaaaatgagctggttcacgatggcaaccccggacatctgctccgtgccgagctgtcccaccatgatgttatccagaaagctgacgagattcgtgatcgcattctgtacaatcatgggcagcgccagatataaatatcttttataaaacgcccggtctccgatatatttttccttaaattctgctaacttcatacgttcttttccttctataagatctcttttgtgtttatctgatcatcttaacatcttcccgcaaaaaaagcactgtttttttgaaaaacagtgccatttcccgtctgccgccattgctgccactcagaacagatccagcatattgtccagataaattttttccctgacatgcagctgatacccgggtttcgtcatatagtagagaaggaactccagaatcagcgcactgccaagtccccgcccctcgatcttgaactgggaaaatcccatgggcaggtagacattttttatggcgtccgtaccgataaatcccggattagccatcgctttggaaaacagatagccgccctctgcatccggagccgcgcagtgatgctccccgccgctttctccgagatttttgcgactgacggcttcgtaacagcgcttcctgtccctgcagccaaaccagcagcattcattgcacagaaattccactttgtccctctgccatccggtcagcgtatcccattgcgcaaacgccttattcagccggaaatccggcacgacatagcggaaatcctcccggtcgatctccccgcgaagatcctcaaaatccgtcagaaccttggtggtcgaggagacaaaatagaaccccggatactgctgcttcaaatacgctaacaacagatccgagtgaacgatcacaccgtttctttgatccccaccttcctcaaacagggcacacaggtcattacatttccggtccgagagatgctcctcccgcagcagagagttgctgaacgtcagccgggcagaaattccgtactcccgcagcaacgccagaatctccgcggagtcgtgatctccgaacccgacgcggcctccgccccagagacagtccgccggtgcaccatagatcgatccgatgtcgcaccagtcgtaaaaatattccctgtgctcatagaacagcggcagaaacacgcgatacaattcataaaattcaaacagccccggaaggtgatagtatgcggtatctttttttaatgaagccatatctgcctcgtcacctcgctgattcccggtctaggcaaccgtgatcagttcgtactcgcgggttccgaaacctaaggctgcggccgcctcgatggtgtgtacgccatgtctggattcgattcgctcgagcagatgatctctgcccggatcgtcactcgcatagaccagatcaagacatgcctgatcaattgcaatcggatctgtcgaaatcaggatacccatatcctccatgcacggatcctccgccactgcacagcagtcacagtcaaccgacatatttttcatgacattgacgtaaactgcattccccttaaagtaatcgacaacggaagatgccgcatccgccatagactccaggaaagagtcgtggtctgccgtccagatatcttccggctttcctgcaccatgaatatatgccttgccggcggaagatgcaatgccgatcgaaagctgtttgagcgctccgccgtatcctcccatcggatgtcccttgaaatgggagagaaccagaagcgaatcataatccgcaaggtcttttcctacaaagttcttctgaatgactttgccgttcgggatcgcaagctccagatccggtccctccgcatccagaagatcgactttaaagtaccggctccatccatgtgcctccagcgtctttttgtgcttggcggttgtattacgctcgccttcgtatgcagtgttgcattccacaacggtaccgccaacgtaatcaatgaccggcttccagaattccggttttaaaaaattctggttccccgcctcaccggagtgaagcttgatcgccactttgccgtccagcttcttcccgagaagctgatacatctctaataccttctccgggctgatttcttttgaaaagtatacttttgctttttcactcatatacagaatccagcctttctcctgactcgatttcaacatcgctgtttggaacgtatttctatccgttacttctattccccatttgtctttcatgtattcttttccaaagtatagcacacgtatgtaaagatgtctcttatcttttttaaagaacgatactatttatagaaatatcttttgtttttacaaaacagccaaaagttttccctcataggaagaaagaattatcttttttttctgcaactgcggaacttccactgatgtcagtgtcacactgccggtgccggtatttaaaaatatcaggactttgtcgtccccaaaactacgcgaaaatacatatgctcctgtaatatcattgcagtaaattgtccggtaattgcccttgcgtaacgccacatgctcttttcggagtacaatccagcagctgaacttctctgccagatttccctgtaatctgttgttttctatctgctgctccattactgcctgccagtccatggctgcccgatactccagctctttcattccctcgatatacacttcatccccatagaataccgatggcacgcccacccccataaagagatagaaaaatgccagctccattctctttctatttccattgcaatagcttaaaaatctcggaatatcatgggaatccagaaaattcatctgtgccagactcacctgccatgggtagcggtaaatcatctgctgcatctgggcatcaaattcactgaccgaaagttctccctttccaaaaaaatcccggcacagataagaaaaagtataattcatcgtagaatcaaactggtctccctgaagccagatgcctgcttcttcccagatttcgcctattagaaataaatcctcttttactgctctcaccgcatgacggaaggttctccagaattcatgattgatttcatttgccacatccaagcgccagccgtcaatgtctgcttcccgaatccagtaagttccaacattgcaaaggtactccaccacttcaggatttccggtattaagctttggcatttcctttacataggcaaacgcctcataatccggcggatcagcgtactgtatcgtttccggcagataataaaaccagttataatatcttgatgcttttcccttctgccgcacatcccggaatgcaaagaaatctgctccacaatgattaaatacaccatctaaaataacacggattcctctcttgtggcactgctgcaccagttcttttaaatccactttatttccaagacaggggtcgatttcaaaataatcaatggtatcatatttatgataagacgccgcttcaaaaatcggattcagataaatgcagttaattccaagcttttcgatatagtcaaggttttcacaaattcctttcagtgtaccacccagatgattcttgcaaatccggtccggtaaaatttttccattgctgtcgcttttttcatccggcaaaagcatatgccttgtcgctttttccttcagttcccgtctgtcatttgcaaaactgtccgggaaaatatgatacataacaatgtcttctgcccactccgggatatctaaaatatcctctcttcgaatatatggaaactgaaaatattctgccctgccacaggacagtttctctgcaaatcctcttccataataataaaggctttctgtatcgtcctctaaccggaaataatagcataccctggtatacggagatgtaatcttaacttcataataatcataaagcatatcggatgccacatgttccatttcactttgtttcaccggaagtggctcttccatcgccacccggtctccccaatacagcacgcaccgttttaaatcgtcctttttacaacggattcttattaccagccggtcttctttttctgcaaaggcaaattgtgacagtggaatatgcaaaattgcttctttttccattttatttctatcctttcacaccacctgcagtaagaccggataccatatacttttgtatacagaagaaaataatcagcactggaacagataccaggatagcggctgcggaaaacattccccagcttctggtgtaatcgctggactgtaactgatataatccacctgccagtgtataactgttttcattcagtagaaatgttgtggaaaacagatattcattccatacaaaaataagtaccatcacagaagttacaatgattgccggacgagccagcggcattactaccttccacagcagctggaaatccgatgcaccgtcaattttcgatgcttcttcaatttctaccggaatggtatcaaaataccccttcatattccagatagagaagatgcacatgcttcccgcataaataatcaccagtcccagtttcgtgtccagcatattcatctgttttaaaagacggaataatgcaaacatggacaggatctgtgggaatgcatttaagagaagcagtaattttaaaatgccatttcttcctttaaaacggtatcttgaaaatgcataagatgacaccacggcaaatccgatagcaatgaccattgtaaagaagcttaatacggcagagttataaaaccaccgcaaaaacggcttctgcgtcagtatatttttataattatccagtgtaaattcctttggaaacaaagataatccagaggacaatgctccacttcccctttcaaaggaaagattcaacgcatataaaatcggcaccagtgccagcagacacagtataatataaaaaatatgtaatccgctacgctgtaaaatctgttttctctttttcttagtcataatttttctcctttacccctcgattggtaaacagcgaaaataccatgatgaggaaaaagataatcatggataccgcagaggacagcccatagttatttgaaacaaacgcattctgctgtgcataggtaattacggtttgtaaggttgctcctgaatatgctcccttctgcatcgtaagaagatatacgatatcaaactgcttaaatgtggtaaatgtcgtcataataaccgccggtgcaataattcctttcattgccggaacggtaatatggatgttctttgaccagaaacctgctccatccagttctgcgctttcataatagctgcggtcaatgctggacagtgcaccgtctatcatcataatcataaacggcaatgccatccacaggtttaaggtcatacaggagagaaatgccggcacattggtggaaaggaaatttacctttccaaagccaagtgccaccagaatcttattcagaagaccaaactctgtgttataaatgcctactctccacaaaagaatggacacatatgcaggcattgcccacggaaacatcaaaagggtcttgtatacacgttttcccttgaaatcttctccttgaaatcccaatgcaataaaatatgccacaactacctgtatcaccatatttaatgcggtccaaagtaatgttgtaaacagtgctccaaggaaaccggagtctgcctttaataatgccctgctatagttggatagtccgataaattcataatttgaccagtgaaaaagattcatattggtcagtgatatataacccgtataaataattgggaatacaataaccattccaatcaatatcagcgccggcatactgtaaagccatggtgttaatttccgtttgatcttcatatacacacttctcttcctgattttcctctttattgcttctaaataaactccttcttactgcatatcagcaatggcatccaatgcctcctgctgataagtttctgctgcagtgtcaatatcttccccggatttgttgactgccgccaaaaatgcttctgccggtccccacataacgctcatctgaggaatgtttggcataggctgtgcagtttctgcagttgctttcattgccataatcatctcatttgcagcaacatctgcatcatcatatgctttgctgtttgccggtgcacagtttgatttattcgccagtgcaatacctacttccgggcttgcaattgtctctaatgcttttgcaattgcttctttcttattttctgctgcatattttaagacaccaatgctctgtacaccagaatatggtgccagtccgtttccattcggaagtttaaaatccgctaaggatttaataccaaggtcaatgcccgccgccttgattccggataccagccatggtccaccgatgattgctgctgcctgaccttcattgaataatgcagttactgtgttgtaatctccatctgcctccaatgctgcaaatttctgattgtacgcgatagcatccttggtttcctttgtatttaatccaggatctgcatccttatcaataatatatccaccaaaaccattgatcaccggtgccacattgtatgcggtagaatgctgatttaccagtgcataagttcctgcatccacatcggtatgtgctaccatataatcatacagttcatctgttgtttccggcacatcaccttcccatcttgccttattatacataaagagcaatgtctcataataaaccggcagcaggtactgggtatccttataattacctgcttctacggtcatcggtaataaatctgccattacatcctcactgataacatccgtaatcggagctaaaattcccatttctgcaaatgttcccaatgaatcatgtgcataaagatacatatccggtccgttggattcatcatttccatataactgaagctggtcggtcagaccactcttcttttcaaaggtaaccttgatattatcctctgccagtttctcattcgcacaatctgcaatggtctgcatgatattctcatccccatcatgccagatttttacttctgtcatttcatcccctgcatcatttccaagtacttctgtagtctgtccttcgtcttttcctgcatcttttccacaaccggataatgcgccgattgtcattgcggtacagagcaacagactcaacacccttttcttcataaaaatacctccgttttccggtttctttaggaaaccgttttctttattttctttttttcatgcaatttgttcctcttgctaagtctatatctatcacttcttcccattgtttacaatgtttatttgtcaaaaatgattgactttgttaggaaaccgctatattgtatttgtaaatttatacatttttttaggaggtattttatgtctgttaccatcaatgatgttgccaatgaagccggtgtttccaaatccactgtttctaaagttttaaatcactggaccaccatatccccagccactgtggaaaaggttcatgcagcaattgaaaagcttcattatacccctaactcccgggctgtaaactttgcaaaaggtgctacttccaatattgtctatcttaccaatctggagaaagatactgcttatcggaatccgcatatgtttgacattatgtgcggcgtacaccataccttgtccgaaaacaactattccctaacgcttgtcaacacttctgaagagcactatcccggagaaaaagtcagcgaagttatcacaagccgttcctccgatggtcttatcatccacggctctgccattaataaagaaattgcaaatcttattctggatgcaggctttccacacattatcattggacatccgagttttgaaagctgcttatgctgggtagataccaaccacgcccttgccggtgaatatgccgctgcccacatgatagcctgtggttatacagatgttgcctttatcggagagcgcaaaaccgattatatttctgcccagcgtcaaaaaggatttatggcaggcatgttagacagaggctttcacattccggctgcccgtatcggaaataccgattccagttggcagcacacttattctgttacttctgatatgctgacacagcctgtaccgcctcgcgctattgtatgtgaaaataacaccctcgcattaggtgtcatccaggcagtcaaagaccggcagctttccatcccggatgacattgccatacttacctttgacgtctacccatattccagcatcatcgacccacagcttaccattgtagatatcaatgtctatgataccggtgtgcaggcaggctccatgatgatccgtaagcttcagaacccggagcttctcatccaaagctatacaacgcttcctgttatcatccagggagaaagcaccagaccactgacataaaaaaagtgccctcgacactctcaactctcctgacccctcattcatgaataagatcaacatcatgctctgtttcgtaagaaagaactcttgctctaaacctggtgagggttctgtcactaattggctgctctccaaaactggttgtgtgcagcgcatactgatagcggatatcaaataccctagcttcaacgatctcatcgtcagtaacattaagagcttctttaagaatcagtggcccaacaatcacattgaccggagtattaggtctggatgctttttcactgtaaagaacagaaaaaatattttcatcaatagcaggaacaactttatctgtctgtaagatgaaaagtgctgtctaaaacagtaagctgttgattatcatttttaacaaaagacatatggatgacctcataaaatgctgcctgcattttaccaaagaatccaatgtttttacatatcgtgttaagctttcaaggtacaaatttatatcaaaggttataaaccttttgacaccccaatcctataagttaaaaaaagccccgcgtgcggaactctttgcaccgggacttctcttatacatgatactttgtctgctttatgacatgctgttgacagtcttatacttatagagcatctccgcatgattctgctcctccacctgaatgtctgcgagcagtttgcggacgcccggatcggcaaatacaaacacgtcggtattatactcggaagacaccagcttctcggtaccgatacagtcagtcgcaaggaagcagtcgtttttcttgtcctcggactccgcgagggagtaggtggcggtcgggttataattctttccatcgctgtcgttgcagttgcagttcggcacggtaccgtttaacacctgtcccagcgagtcaaagtgctgctgctccttcttgtgaagatcggtgaacaggttcacgagaaccggatccttcgcctctttgctgtatcgggaatacttctccacgcaggttttctcctgggtctggagatctttgatcgccgctgtctctttttcacttaataccatcgttgttacctcttttcttatttttttctatgctggtattattgggaaaaagtttcgcaattatacacaatatttattttccggttgacaaatgcgcacggccgcgtctataatggcgttaatcggagcagaacacaggctttgacgggaagaagtaagaataagtggaacgaacagaaagcaaccggctgatgagaggtgcacggaaagcttattacgaatacatccccgagcttcacacccaatttgcatgaccgttctttttgcggtgatgtgatagtaggctgtgacgtagcggcgcacgttacaagcgcctgagtgttgtcggacactcgcagaggcagaccgtgtgaatggtctgtgaacaaaggtggtaacacgagtttataccctcgtcctttttgaaggacgggggttttttgtgcggcagcaacggtccggcactgttcggctgttgtaccgccgccagaaaaagacaaccacaactacaaccacaaagaaaggaactgacatcatgacattatacgatgaattagttgcccgcggcttaatcgcgcaggtaacagacgaagaagagatcaaagaactgatcaacaacggaaaagcaaccttctacattgggtttgacccgactgcagacagtctgcatgtcggacatttcatggcgctctgcttaatgaagcgcctccagcaggcaggcaacaagccgatcgccttaatcggcggcggtactgccatgatcggtgatccgtccggccgtaccgacatgcgccagatgatgacaccggagaccatccagcacaactgcgactgcttcaagaagcagatgagccgctttattgatttttccgacggcaaagcgctcatggtcaacaacgcggactggctgatggacttaaattacattgatgttctgcgcgaggtcggcgctcatttctccgtaaaccgcatgctgaccgctgagtgctacaagcagcgtatggaaaagggcttaagcttccttgagttcaactacatgattatgcagagctacgatttctacaccttattccagaaatacggctgcaacatggagttcggcggcgacgaccagtggagcaacatgctcggcggtacggagctgatccgccgtaagctcggaaaagacgcttacgccatgacgatcaacctgctccttaattccgaaggcaaaaagatgggtaagacgcagtccggcgctgtatggcttgatccggagaagacctccccattcgatttcttccagtactggagaaacgtggctgactccgatgtcttaaagtgcatccgtatgctgaccttccttccgctcgaggagatcgacgcaatggagagctgggaaggcgcacagttaaaccaggcaaaagaaatcttagctttcgagctgaccaagctggtacacggcgaggaggaagctgccaaggcacgcgaggcatcccatgcactctttgcaggcggcagagattccgcacacatgccgaccgtagagctttcggctgctgattttgcagagggcgatctcgacatccttgcacttctcgtgaagacagagcttgctccatcccgctccgatgcaagacgtgccgttgagcagggcggcgtgagcgttgcagatgcaaaggtcaccgatatcaagaccacctacagcgctgattccttcggtgctgacggtcttgtcgtaaaacgcggcaagaagaaattcgtcaaaatcattgtaaaataagatagtgcatgctagaatacaacaagacaaagaggggactgcattttgcatatcccttctttttcaatgataaaggagtatctgtcatggaataccgtgaggagagaaaatatttctgttccgactatcagttggagatcttaaaacaccggcttaaagccatccttccctatgatgtccatcagaaggattcatcctatacgatcagtagtctctattttgataccgcagacaatcagtgctattacgaaaattctgccggcgtggatgacaggaaaaaatatcgtatccgtatttacgatcattctgattcaaatatccggtttgagatcaaagaaaaattgcgtggaaaaacgaaaaaatctacagtcccgatcacccgcagtcagtgcgaggatctgattgccgggcactttctacctgcagataatgattcttccgttctcagtcagatttacttaaaagagcacctgcagtttctgcaccctgccgtcatcgtcgaatacgagcgtactgcgtttacttatccgatcggaaatgtacgtattacattcgaccggaatatttccgcaatcgcagatccatcgggtttcttttcggcacaaaatgcccgcatccctgtcctgcccacacatgagcatgttttagaagtaaaatacgatgaactgctgccggatcacattgcccagctgttagagcttgacacgttgacccagaccgcctgctccaaatattttctctgcagacaggcgtgtgatattaccaaccaattataagtatccatacgaggaggttatttatgagcaccaaagatatcatcaagaattctgttcttgaaaattttaccgctgacatttccctggcaagggtatgtatttccctgggacttgccgttgtactgtccctttacatcttttatatctaccggatgacaacgaagtccagcttctattccaaagaatttaacaaatccatcgccctgatgtccgttatcactgctgccatcgtgcttgccatgcagtcgaacctggtcatctcacttggtatggtcggtgcactttcaatcgtccgtttccggaatgccatcaaaagctctatggatcttgtctttttattctggtccatcagtattggtatcatctgtggcgccggactctatgagatcgcatttgtggcttccctgatcctgactgttctcttattcctgctcgacctggttccgacaccgaaggcagcgttacttctaatcgtcaacagttccgatgtcaacactttttccgaaattgaaaatctcgtgaagtcccacaccaaatcttttgatgtaaaatccaaaagtctcacgaaagacggtttggatcttgtgatcgaatttaagtgtaaagaaaatgaagatgccacgctccttgccacacttcatgaactttcccatgttacacatgtttctatcctgtcccatgacggagaacgccgtttttaatgattttggagattccgatgaaattcaagatttctacctatataaaagaactttttctgtttctgttgctcgttgctgcaactctgcttgtcctgatcgcaacacacaaggcatcacatacccgtacgatcgtgatcaacgaagtgtgcagcaacgatttttctctggtggaaaattctgccgggaaatatgctgattatattgaactctataatgcaggcgatacaaccatttctcttttaaactggaccctgcataccggaaaaaaagattcaggaacgtacacctttggagatatccgtctgttaccacaggctcgtgtgctgctgatccatagggatgatgccgcatccgacacagacacttccagtattaccgtctccccgaaggattccttttctctggaaatcccatgctctgtcgccaaagatggagacacgctctatctgcgcaattcctccgataaaacaaccgactacgtgactgttcctgctctcacctacaacaccgtgtatgccagagagacggacggcgcggacacctggaaaattcttaccggcactccctgtacggacaacgcatctgcctctgctcctttctgggcggacagggatgacgcgcccgcagagcccgcttatccgttaaccgatctgtcactccctgcggaagccgccgatgctgccgttttatcaatctccatcccggaggactctctctatggcgatgacggtatttttctcagtgaaaacagaactctctccggccgcacagcggaacgggaatgccaggtcgattatttctccccggatcgttccaatgagagttcgttttacagcggactgcgtgtgagtaagcggtcaaataatctgcagtgtctggattttaatctttatgcacggaatatctatggatcggatacgttttccacagattttttcggtaatggtatagaacatgacagactgctccttctacacggagcagataaacagtatctgctctatacgcttctggcacagcagaatatacagactgtctccttcctcccatgcagtgttttcctgaatggcacattttacgggaactattatctggcagaacctgtcgatgaaaactatctcaagtcttcctatggtgtctccgggaagaatctgaccatacttaccgaaaaccagctgacatacggttcttcctatggactgttggaataccgcgcactcatcgcagatgccacagccaacggtctgaccgatcctgctgcctatgaaaatttctgtgaaaagatcgatattgacagcctgatcaactactatgtgctgcacattcttctgaatgacaatgatttttcaccttatgactcctgccttgtctggcggagtgaaacagttgatccgggaaataccttttccgatggaaaatggcattatgagatcaccggactgtcccgggctctctttacccaaaacagcaatactctgaccaatacattttcccacgtgcaggatactgatccgctgtttgaagtactccttcagaaccccgatttccgtgaccggttttcggaatacttcacagatcttgctgaaaaccggctgaacgaggctgcggcagaggcactccttgccggcaccacttacccggaagaggatacagacaatctggaaggcgaattttcgcagttcttccgcgaccgctccgtatttattttaagctacctggaagatctcctcacagaagagggactttccgattagacaggagaaagaggatactcttatgaaatcatttgatcagatcaaaaaatatatttttgtactccccgcgtttcttctcttagtgggaattctgatgggaatacaatatttaaacgcaacacccgcactttcggatgaaagctcacagacagagtacgtggatgactactgcgtcactttttctgcccccagtggcttttacgatgatgatttttcactgacattatctgcaccggatggtttttccatctactacacgctggatggctcgcttccggatgagaccagcgagcactacacggctccgcttgccgtcacaaacgtttcctccccagaaaaaaagtatgcaaaccagacgatattttccgttgatggcaacaacgtgtccggcgatgtgcccgaccaggcttatatcgtccgggcagttggaatcaatgatgccggtgtatcaaccgatgttgtgaccgagacctattttgtgggctacgatggcttttatgacggttactccgttgtatcactcataacggatccttccaacctgttcgattccaaaaccggtatttatgttctgggagattcctactacgaatcgggaaatgaactggatgccaactttatgcagacgggaagtgactgggaacgtccggtgcatattgactactttaatatggataagacctatgccttttcacaggaaggtggaatccgcatcaacggaaactcttcccgcggtgattccagaaaaagtctccgcctgtatgcccgaaaaaaatatgacggaaacagcctgttcacctacccgatcttcagcaataacatctatcccaactctgttatcctgcgccgaggaacatttattaatcagtttcttccttcgctcgtcgccgaccgtaatatgggaacccaggattatgttccatgtgttgtatttattgatggggaatattggggaatttattatatgattgagcgttatgatacagattatctggcggggcactaccaggtcgatgacgacaacgtcacgattttaaaagacggggaacttttttcgggatctgcatattctctggaagactatagacagcttctggcttatatggatgcaaatgatctaagcatttcagaaaactatgatactgtatgctcacagttggatatccagagttatattgattattatgcaacccagatctatatcaataactttgatttttcggaatcgaaaaatcaggtcatgtggcgttcggacagcaccgatgctgcaaacccctacgccgatggaaaatggcgtttttccctgatggatgtcgatctgtctctcacttccttcggcggtgtcgaaaactatgccacaaacagcttttccgatacagaatcagctgtcgtaatccagacggaagagacgatgttcaaatccctgctcgcaaatgcctccttccgccaacagtttgtaacgaccttcctcgacctggaaaaccagaacttttcctacgcgaccgtgcgcgcggcgatggatacctgtcttggctatatcgacgatcctgatatgatggacgcatactttgccaaccgccccgcttatatcaacgactctctcgcagaaaccttttccctgacaggcactctcgtgcccgtgaccctctcggtcaatgacgcctctatgggagagatcctgctgaatacgatcacaccggatctatcctccggcagctggagcggcaactactacaccgactatcctgtcactgtcacagcagaaccaatggatggataccggctgaaggagtggttgatcaacggagaacacatcacagacccttccaccagcgtgactctgcccgaaagcggagccgatatccaggctgtgttcgaaccgctctcctgataaagaccggttcgtccccctcaatagtgcagcatctcgatcaaaaagagccacgcaagcccgtagtatgtcactaccgccaccagatcattgaccgtcgtgatgagcggtccggatgcaacggcaggatcaatatgaattttgtggaaaaacatcgggatcagcgttcccaccaggcttgagatcagcatggcaaggatcaacgccgctccgatacagccggacaccgcaaaggcgaactgcagggagccggacttgaaaaagtaaatgtaacacccgatcaggataattgacatcataccaaggatcagaccgttgctaagtccgacgcgtgcttccttaaagaccaggtgcactttctgcccggcagtgagattttcatccatcaacacacggatcgtcacagccagggactgcgttcccacatttcccgccatatcgagaatcagcgactgaaagcacatgacaattgtcagttctgcgaccacgtgctcgaacatccccacaacggaggacacgaccagtcccagtccgagcagcacgatcagccacggcatacgctttttgatactgtcttttaacggctcttccaaatcttcctccgcagtcagaccggcgagcatggcataatcctcgcccatctcgtcatcgaccacctcaacaatgtcctgcgaggtgatgactccgatgatccggttctcctcgtccagaactggaatggaatcttcggaataatccttgatccattcgatgcagtccgcgatctcctccgtggcatagacgaacgggtaggacaccacgatcagatcctccagattcgtgtcctcccgcgcgatgatgagatcattcagactgatcgcaccgcagaagatacggttctcatctacaatgtaaagtgtggatatgttgtcattgtctgccgcctgccggatcaactcgcgcatagcctgctttacggtcacattagacggaatctccacatagttggtggacatccggtttccaatctgctcttcatcaaaagaatcgatgagatcgatcttatgccgtacctcctcatcgagcagctccgtcagcgtctcgcgttcttttttgtccatctggcgcagcagatcggcaatttcatctgcgtccatctccgagacgactgctgcctttttcttcatatccatctcttccagatagaacggaatctcctcctcatcgatgtaggagagaacctccgagatctcctccgcatttagaatgcggtacaggcgctgccgctcggtgggattcatgtcttcgagcgccgccgcaatatcattctcatgataatccagaagtctgtcacgcatcaccttcggggatgacattccgcgtacaatcgcctcgatctctttttgatatttcatctgaacttccgtcacatcttccagtttctttttctctgtcatctgctctttcatgcaagccaccatttcctttccgatgttgtcacattctgccgggacaaaatgtgcacgcaaacaacgaacgccacgttatttatggcattctgatacagacagcgcacggctgtctccttgttttcggcatgatttgattatgttgtctggaaatattgtctgtgaatacagagcataagaaaaaaagatatcctcgataatcgttcttcgatcaaaaaatggcaggcagactgccgctcattctttccccacagacaatatgattacttcgtccgcaactgtcgtcagtcatgctgccacctccattcttattttaatccgttgctatcctaacatatttgtctcagttttgcaacgcactttttctgccagccaggttcgcaccagcggaagccagctctggcactgctcctgcacaccatagccatccacattcatggataactccgtacaggtcgataacccgtgtccgcctgctggatacatgtgaaattccaccggcacattcaccttgcgcatcgctgcgataagcagcagggaattctcaaccggcacacagtcatcggtgaacgtgtgccataaaaataccggcggcatgtgctctgtcacctgcttctccagtgagactttttccatcatctcctccgtcttctgtccctttaacagagcttcaaacgatcccctgtgtgcatactcgccagacgtgataaccggatagcagagaatcagtcccgccggacgcaggatctcatttgccacgccggctctctcggaaagccaggattcgtgccagaatacgcccagacttgccgcgagatgacctcccgcggagcatccctctacataaatctgctctttcttaacaccccattccgcagcgtgtgcatggatcagcttcatcgcctccgccaactctaaaagcgctgtcgggaacaccgccggcgcacaggaataacgcagcacggcaacatggtatcccattgcgagaaactgtactgccatcggctccgcctcccggtccgaggtccattcgtatccgcctcccggacacagtaatatgagcggccgctccttaatccgaagctccctgctcttttcctgaatgtagatacaaagtcttgcacccggctgggatccctccacctgtattgtgattgtttctgtcagcatctgtctattctccccgtcttttcttaatatacaatctggttccgcccgttctctttcccatgataaagcttctgatccgcagcacggatgatcgtttccatatccttctctccgctatactcctccagtccaaatgtcatggtgacatgaatccaatcgctctgataaggaatgcccatgccgcggattctcttcaatatatcgtgaagtacctcattcgcctgatcgccgtttttattctgaaatacaaacaggaattcctctccgccccagcggcagacttttccttccttttccatcgcctccagaaaaacttttgccagttctttcaacaccatatccccggcatcatgcccgtaggtatcgtttgtctttttgaaaaaatcgatgtcgccgattgcaactgacacatatccaatctctccggacgcatattttccggcgattttctccagatacgaccgcatgctccagcggttgtacaggccggtaagcggatcgatggacgccatgtgttccagcttctcattatattttacaagcttgtattccatctcctgcgaatctctggtaaacacgatcatgattgccgtcaattccgcaaaaatagcaagcgtattgataatctgaaaaagaacaccggtatccacagaaatatttgtcaccggatcatacctgttcgtataggcatacagaaaaatacggtacgcacatgccagtgccgcagcgccgatcttcattcccatcgttcccgcgctcacggtaaaattgagaaccagaagcacaaacacaaaatgttgtacaccgcagtcccagccatactcccagataaaaatcagaatccatagcgccatcagcgcctgcgaaaatatcgatgcaaacttcgtatgattcagataggtcgtgtaaaaagatacgagataacatcctatacacaccaggcagatcaccgctgaacggatatccttaatcgcgcagaatacagcaaacaggcttaaaaagtacagacacagcatcaatgcgctgatccgtagcgtaaccgccgtcttcttcgtctcgttctcgctctgcacgtcttttaatacaaagtcctttatcttttgcaccatagtacagtcccctcccccagaaaaccgtcctttctccatagttctatcatatacatttgaagtctttttttcaaggttttccttatatcttaagtaccatatattgtattccaaaaaacattgcatcccctggcgcaacgtcatttctttttctgatcttgatgtaaaataagataacatgtaaaaaggcgtacgatttctcgtacgccattactgacccaaaggcgactgacggatttgaaccgacgatcagggagttgcagtcccacgccttaccacttggctaagtcgccctatctctcttatatgcctattatatgcagcttcccgtcatttatgacagatcacttctgccgggaagcatcacatcagacacacagagattttaacaaaaccattgtctcccgtcaagtcatatttttaaaataaacagcatctgccgcctacggcgttccaaaaacaaatgtcacatacatcgttgcctgatcgtaagttccgtcttccttcggatcaagcactgtcttcgtcagcatatattccccgtccgtcagcgtgctgtacagccactcccatttgacatccgtgaccacgctgctgtgcgccggaatggaatagaccccctcgttaaacctgtaattgggaaccagcgtcgacacgtccacccagtcgctcccgatatatttctgcagatgaaaatcggttccgtacagaatctcctcatccgtataatttgagatcgtaaccgatgcctttccgccttccacacggttgatgtacattgcgtaaggtacttcccgttctgcctcctccgtatcctcgatcggtacaacctccgttttatttccaccgcaggctgtcagcattcccatgcagatcatcgcgatacagcctgttatccataattttctcatgaatcttcctccgataacgtcttcctttttattataaccgataagtgcatggtttgtctcgaaagattttcttatttattttacttgacaactttacttgtcatacatataattattttgacaagtaaagttgtcaatgcatggctctttgtgtcgcagatgtcacaagcagcctcaaccgtcgatggaacggaagctctggctcccggtttcttcaacacacaacgtctgcggaattggaggattatatgaacgaagaaatgacgccggattatatgaccggcacacccaatactgtctgtgcagatgccagacgacaattttcccgcatcggtctgatgtttctgattggaaccgtgctcatctatggagttcagttcggcgcaagcggaatcgcaaacgcgatcaatccggatctgctttccagcacgagctacgcgcttttgattgttatgattcctatgtatgtgatcgccatgccggtcatggcacttctgatcaagaggattccggctgtgacccttcccaaaaaacacatgaccttcggtcagtggctgatcgcttttctcatgtgctatggtgccatgtatgtgagcaattataccggtcttgtcctgacacagttgatcagtatcctgaagggaagcccggtaacaaacaccatgcttgaagtcgccacaagctccaatctctgggtgaatctgtttatcatggtactctgcgccccggttgccgaagagctgatcttccggaagcttctcattgaccgccttgtacagtacggcgagggcgtagctgtgcttttctccggcctgatgttcggactgtttcacggaaatctgaaccagttcgtctatgctttcgttctcggcctgtgcttcggctttatctatgtcaaaaccggcaatatccgctacacgatcgggttacacatgctggtgaacttcctcggctctgtactcggtgtggcgatcttgaaatggctgggagatgattttctctccatcgcttccgatcctgcaggcatgatgtcctacatgacaggaaactttggaaaactgatcgtttactttatttacattttccttttgctcggcgtggcgattgctggtattattctctttatcgtcaatctgaagaaaatccgcttcctgcctggaatgaacacgattccgaaaggaaaacgcttttccacaaccgtgttaaacgttggaatggccctctacatgatcgtctggatcgtgataatcattgtacagctcttgcaataatgaaaaaagctgccgcaggtatcccgttttatcggttctattcctgtgacagcttttattatgcaatatttactgctctttcccgcagcttctctaattttccacggtctgcccatcctgtgcatttaagatgctcataaattcttcccctgtgatggtctccttgtcatagagatatttcgcaagttcatccagctttgcgcggttgtccttaaggatcttcgccgccttctcatgctgcttccttaccagttccactacttttctgtcgatctgtgcctgcgtgtctgctgagcatgccagggatgcatcgccgccaaggtactgattggtcactgtctcaagcgccaccatatcgaattcttcactcataccataacgggtaatcatcgcccttgccagcttggtcgcctgctcaatatcgttagaagcacctgttgtaacacaatcaaataccacttcctccgcggcacgaccgcctgtcagcgttgcgatcttgttctcaatctcttccttattcatgagataatgtgtaccttcctctacctgcatcgtataacccaacgcaccggaagttctcggaataatcgtgatcttctgtaccggagcggaattggtctgctttgccgctacaagggcatgaccgatctcgtgataagccaccgtccatttttccttgtctgtcagaatcgcattcttcttctgataaccggcaatgacaacttcgatgctctcttccagatccgcctgtgtcgcataggctctgccatcacgcaccgcgcgcagcgcagcctcatttacaatattcgccagctccgctccggatgccccggacgccattctggcaatcttgttgaaatccacattatccgatactttgatcttctttgcatgtaccttaagaattgcctctctgccgcttagatccggcagttctaccggtacacgccggtcaaaacgtcccggacgcgtcagtgccgggtccagagactccggtcggttcgttgccgccaggataatcactcctgtgttgccctcaaaaccatccatttccgtgagaagctgattgagtgtctgctcacgctcatcatttccgcccatatttccgtcacgctttttgccgatggcgtcaatctcatcaataaatacgatacatggtgctttctctttcgcctggcggaacaggtcacgcacctttgaagcgcccatgccgacaaacatttccacaaattcagatcccgacatcgagaaaaacggtacgttcgcctctccggcgacagccttcgccagcatcgtcttaccggttcccggagggccgacaagcagaataccttttggcatggatgcaccaatctcccggtacttgtccggattatgcagataatccactatctccgtcagattctccttcgcttcatcctcgcctgccacgtctgtgaacttgattccctccgaagactttacgtatactttggcattcgacttgcccataccgaacatcatcgcgttcccgccgccgccggctttgtccatcagacgcttgtacataacctggccgattatcatgaaaatggcgatcggcacaatccagcccagcaatgcgcttaaaaacggagacatctgctctacaatctgacttgcaaactccgctccggaatcatgaagccgctgtaccagatccggatcattcatcggacccgtcttgtaaatatttccatccttgtccgtaaagacgatctcactctcatcgatctcgacttttgcaatctttttatcttccgtcatggtcataaacgttccatagtccacttccctgacctgacgctctgccatccacggaatcgccataaaattcagcatcatcaacagcagaaaaaccataacataatagaagatcagaggttttttcggtgtttttacttcattcatactgactcccctttcctgtttattctcttatatattgtgataattttaacacggtttctaaacagtgtcatattatatttttataaacaaatctaaaaaatttgcgatccgttttccacacaatccagatgcagagtgatttttaaacaaaaaaagatcccgaaaaaatcttcgagatctttacagaggcgactgacggatttgaaccgacgatcagggagttgcagtcccacgccttaccacttggctaagtcgccatatttaagcacggacagaataatgatgcccgctttacaaaattactgataaaaaaactccccgagtaggactcgaacctacgacagcgcggttaacagccgcgtgctctaccgactgagctatcgaggaatactaactgaaagatacaaaatgacacaaaatgacgtagctagtacgtcatttactatataacaaaattgttataattgcaatacttttttaaattgtaccttcaaaacttcatacagaaatcatccaacaaactttttggtcaagccctcgatcgattagtaacagtcagctccacacgttaccgtgcttccacctctgccctatctaccttgtagtcttcaagggatcttactcacttatgtgagggatatctcatcttgaggggggcttcacgcttagatgccttcagcgtttatcccttccggacttggctactctgccatgccgttggtcgacagcagatacaccagtggtccgtccatcccggtcctctcgtactaaggacagctcctctcaaatatcctccgcccgcgccggatagggaccgaactgtctcacgacgttctgaacccagctcgcgtaccgctttaatgggcgaacagcccaacccttgggacctgctacagccccaggatgcgatgagccgacatcgaggtgccaaaccactccgtcgatgtgaactcttgggagtgataagcctgttatccccagggtagcttttatccgttgagcgatggcaatcccactttatgccaccggatcactaagtcctagtttcctacctgctccacccgtcggtgtcgcagtcaagctcccttctgcctttgcactcttcaaatggtttccaaccattctgagggaacctttgagcgcctccgataccctttcggaggcgaccgccccagtcaaactccccgcctggcattgtcccaccgccggatcacggcggctggttagaaatccaatactgcaagggtggtatcccaacagcgactcccttgaaactggcgtcccaagttcttagtctcccacctatcctgtacatgcagtaccgaatcccagtaccaaactggagtaaagctccatggggtctttccgtcctggcgcgggtaaccagcatcttcactggtacttcaatttcaccggatgcattgtcgagacagtgctcaaatcattacgcctttcgtgcgggtcggaacttacccgacaaggaatttcgctaccttaggaccgttatagttacggccgccgtttactggggcttaaattcaaagcttcgcttgcgctaacctctcctcttaaccttccagcaccgggcaggcgtcagcccatatacttcacctttcggtttcgcatagacctgtgtttttgctaaacagttgcttgagcctattctctgcggcctgcgttagcaggcaccccttctcccgaagttacggggtcattttgccgagttccttaacaatgcttcttccgccggccttaggattctctcctcatccacctgtgtcggtttacggtacgggcacacatgaaacaatagcggcttttctcggcacatggctcacacgcttcgctactttaattcgctccacatcacgtcttcggattgcctggcggatttgccaaccagactccttctccgcttgtaccggtatttccattcccggctcgtgctctccacatgcgtccccacagttctgttcatatgtggtacaggaatctaaacctgttgtccatcggatacgtctttcgacctctccttaggccccgacttacccagagcagatcagctttactctggaaaccttggatattcggccgagaggattctcacctctctctcgctactcattccggcattctctcttcttatccctccactgctccttccggtacagcttcgtcggtcttaagaatgctcctctaccaatcacttacgtgattccacagcttcggtgttgtgttttagccccggacattttcggcgcaggacctctcgactagtgagctgttacgcactctttgaatgtgtggctgcttctgagccaacatcctagttgtctttgaaatcccacatccttttccacttaacacacactttgggaccttagctggtggtctgggctctttcccttttgactgcccaacttatctcgtgcagtctgactcccattcatcatctacatggcattcggagtttgatattctttggtaagctttgacgcccccgcggaaattcagtgctctacctccataagactaaaatgaggctagccctaaagctatttcgaggagaaccagctatctccgggttcgattggaatttctcccctacccacacctcatcgccacccttttcaacggatgtgcgttcggtcctccattgccttttacggcaacttcaacctggacatgggtagatcacccggtttcgggtctacggatactgacttgacgccctattcagacttggtttcccttcggctccacaccttaagtgcttaaccttgccggtacccgtaactcgccggaccgttctacaaaaagtacgcggttgtgcatataaagcacttccacagcttgtaaacacagggtttcaggttctctttcactcccctcccggggtccttttcacctttccttcacagtactatgcgctatcggtcactaaggagtatttaggcttacggggtggtccccgctcattccatcaaggtttctcgtgtctcgatgtactctggataccgccatgtcatctttcctttcgcttacggggctttcaccctctctggcaggctttcccaaaacctttctgctaggattgacaaatcaattatgcggtccgaaccccggaatgcacgcattccggtttggcctctttccatttcgctcgccgctactttggaaatcgatgtttctttctcttcctccggctacttagatgtttcagttcaccgggttcccctccatacgttatggattggcgtatggatacatgaggtatgctcatgtgggtttccccattcagatatctacggatcaaaggatatttgctcctccccgtagcttttcgcagcttatcacgtctttcatcggctcttagtgccaaggcatccaccctgcgctcttttttgcttgacctcgtttacagtttctatagcgttagaaactgggtctttgcgtttaataacgcggatcgaattgcttcgatcttgaactttcgttcgtttggtttggtcgtaaactttgtttacgatattctcggatgtcttgataaaaaatctttttcatcaaaatcttctgtatgaagttttcaaggtacaatagcgaacttcgttcgcattagaaattgcttcgcaatttccgcaacatcggcatttttcaatgcttttgttactgtctgactgaatgtttatcagtcattagaaacctcaacgtattgaaatctctaatcactggtaaaaccagttttatcagaacaacactaccctgttggaataggttagcaccaggtcgtctgactcttgatgcccgttctatatagaaagcttttcagcttgtttgctttttaatctggcagccacctgctttcccataccgtcgccagtatagtatcatcggccgcttaggtcttaaccatcgtgttcgggatgtggacgggtgtttcccctaagcgcatcgccaccagaaatatgaagttttcattcggactgctcattgttctcatgactcgctcgacttcgtctcgctagagtcattcgtccaatccgtcttcgcatctgctccaattcgcaagcaagcttgcattgtcgcatttgctcatccggcagtcctcattgataactaaacagtgaacaaacactctacttgatttccttagaaaggaggtgatccagccgcaccttccgatacggctaccttgttacgacttcaccccagttatcagtcctgccttcggcagctccctccttgcggttgggtcactgacttcgggcattaccaactcccatggtgtgacgggcggtgtgtacaagacccgggaacgtattcaccgcgacattctgattcgcgattactagcgattccagcttcgtgtagtcgagttgcagactacagtccgaactgagacgttatttttgagatttgctccccctcgcgggattgcttccctttgtttacgccattgtagcacgtgtgtagcccaagtcataaggggcatgatgatttgacgtcatccccaccttcctccaggttatccctggcagtctccctagagtgcccggccaaaccgctggctactaagaataggggttgcgctcgttgcgggacttaacccaacatctcacgacacgagctgacgacaaccatgcaccacctgtcaccactgctccgaagagaaagtacattacatactctgtcagtgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagtaatcgtccagtaagccgccttcgccactggtgttcctcctaatatctacgcatttcaccgctacactaggaattccacttacccctccgacactctagtccgacagtttccaatgcagtaccggggttgagccccgggatttcacatcagacttgccgtaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtgggccgttaccccgccaactggctaatcagacgcgggtccatctcataccaccggagtttttcacactggatcatgcaatcctgtgcgcttatgcggtattagcagtcgtttccaactgttatccccctgtatgaggcaggttacccacgcgttactcacccgtccgccactcagtcacaaaaacttcattccgaagaaatcaattaaagtgcttcgttcgacttgcatgtgttaagcacgccgccagcgttcatcctgagccaggatcaaactctcatgttatagtttgtttccttttccagaataatctggcttattcagatgttactctgaatttactgttttaggttgttctttataagaacgttcgtccgtctttcaatctcttgatcgacagcttgaaatttaggatctttcaaggtttattcactgttcagttatcaatgtgctttgttgtcatctctcggcgacagcttatttactataccatagtatcaaccgtttgtcaacaactttttttattttcttttgcttctttttcagaagccgttgttgtctgtgttacttattttacgcgacaactcattcataatatcatgtatcgaagcgtatgtcaacaactttttcagaaaaaaattgaacaactcatatcttcaaataaagcggagaaggagggatttgaaccctcgcgccggttaacccgacctatacccttagcaggggcacctcttcggccacttgagtacttctccaaagttcttatctgacaatatgatattgttctgcgccgtgacgcatagataataatactagaagtttctccgtttgtcaatggaaatattcaaattttattttcaaaggaattgccgctataagcatagcgctctttagggcgataagtaatattactaagaaacacaacttcgggatttcatgtggaaatgcaaatggaatattcgttggagaaaaatgtgagcatttcttccggctgaatgtttgcatcggattccgtgtctcttccacgtttggacaatccgacgggtgcatgtccggcacaccggagacaatgggcggactttctggtgtccctaatggcacctcttcacagacaatataaaaccgcgcgaaccgaactcgccagcatctgctattgaaaatagggcagatgccgactcagacagcggcttcgcgcggttatgttttgttcagaggtgccaataagggacacacacaaaagtcctacaaattgtcttccgggatacggacatgacccgcggagtgctccaaacttggaaagacacggatcatcgaagatgcaaacatccggctggttagaaatgccacattttttgaaccgaatttccatttgcatttccagctgaaatcccacggtgtggtctttttataatattacttatcactccaaagcacgatatgcttattgcgacaatccattcagcgtatttttattattcgtctctttttcttatactatagaaagtaaagcttccatctatgaggagcgtctgctcatcgtttaacagttctacccggacaaccgtgatcttccttccgtggcgcagcaccctcgctttgcagtagacatactctgtatgttccaccggaagcagataattcatcgacgcatccagcatggtgacgtattccctgtaagtggatgccgctatgccggatagcgtgtccgcgagggaatatgcacagcctccgtgcattcccccgtagatattctcgtattgctttgccagacggatccgcccaagcgcatatccttccgtcacttcgagaagttccatgcctatatgctgtgcaaacggattcttccgcacgatctctttcatatcctcaaacgtttgattcattaccactcttactgccgctttcatccccttttgccgcaaagaactgcaaattcattggcatcaattgggaattacttgctttcttctgcgcattaagcctttcctgggttctccagtcggtgttgacattatctcttggggaagtcgctgtgtaatcaggaccgctcttctttacattgttggcagcatagttctttgccctctcctcaccatggacaatctcatagtttgccagcttcttcgcatctgttgcattatatccctgactcttgtacttattgtataagtcctgtttcgagtttgcatcaggatagcactgcgttgcaagctttgctgtatccgggtctgcccctgcattaatgtactgctgttctttcctgctgtatgggctgttctccttcgttccatgtcctgtcgggtcatggttaaggatcgggttattccggcagtaggtatacaggttcagtccgtcgccatagtaggtatcttcctgtgtgaatctggcaatgacagggttataatatcttgccctcaggtaatactatcccgtcagaggatcgtactgctctcccatataacggaagcggttctctacctgctccttgcagcttatggtattcccaaaggcatcatactcatattgattgagtattctgtcctgctctcttccctgtgctgatactccgctctccttatcctcatctctgatgatatggctcacactgccctgttcatcggatacataatggtaatacgtcttggcgttctcgctgtcagaactgattaagcccagtccacgtatataacggatgatgttgccgctgcagtctttctctgcgactacttccctatcctcattatagaggaactgcactaatctgccgttctcttccatctctgcacgaagaccctcggcatcataacagttcttctgaatgtccgaaagtataaccctgattataactattttaaatattcatttgacttaaatatatactttttcataagttccgctcttttattatctagttctgatgttccaatttgaacatcaaacttaaagaaaaacctatctgatatttcattttctaaagatttcaattcgtctttatctgtatgattctttaaaaaatccatccaatctctggcttcattttcattctgaatcaataaataatctttttcctccttcttcattaattcaatagtttctattaactcactcaatattactattaattcgttatgtttttcgtcgtcaatcttgttcataattttctcacttccacgttgcaggtgttatctcaatccaatctgcaggtactgctctataatcaatatatgcttgatgtgccccaccatataatcccattccttgtggtccaacttttccttctaaagctcctaaagaagaaccttctggtatagtcatcttatataaagtagatgcatcattacagaactcctgtttaattgcataatccactctccattgatattcagttgcaggaggtggttctaaactccaaaatccgccattttttccaccaattctatataatgtagtcccgccttcatacgtagtaggtgttgcttttcctcctgcaaaggaatttaaaacatttcgttcccattgtgaaccttctggtaatgttggtactcctacatttttttgtgtcaaactagttgttttaccactcttctcccggatatttcatgttccactctttgcgcagaccggtcatgagttccatgacgtcacgggtatcttttaagcgcattaccccggtatttccgttcaagatagcatcttccatgtctgtcatttcatacaataatgcatccgccgttgcacctgccgtgatctcatgcacctttccggtctctgcttccacaacgatagcacggtcggcgcgcggatattccatgatctctatatatcctttttcacagctgattacagcgcgctttggctgtttggagtgtagggacagcgacagcgccgccatctgtccgtccggattcatcagaagaattccctcctgttcatccgcgccggtcggtgcgtattttacctgggaaagtacttgatcaggctggcttgacataaagcttcttgcaatggaaagtgcatagacaccgatgtctaagagtgctccgcccgccagattcatattgaagaaccggttcttcatattatattccttgtagcttccgaaattgagctggataaactgcaccttcccgagtgccggaatctctccatcccccgtctcaacaatctgccagagcttcttatataaaggcatatgccagatcgtcatcgcctccgcaaacacaacatggtgctcctctgcaagcgcaatcgcctccgcaagctcacggctgtttaacatgactgatttttcacagagcacatgcttcccgcctgcaagtgcctcgcgggcgaattcgatatgcgtattgtgcggcgtggtaatataaatgacatcgacgtcgggatcatggaacatttcctgaaaatcgtcgtataccttctgtacaccgtacttctccgcaaatgtgaccgctttctcatgtgtgcggttgccgaccgcgtagagatgctttcccatatgctctaaggcctgtgccatttcatttgcgatgacaccgcatcccaatactgcccagttcaactcttttttcattgtggtacctcctgcatgattttactttttttatcaatacaaatcaaaaatactcatctgtggatctttccaggaacgctggattgcatcttttacaatgtctgtgctctgcacatgcccgatcagaagcggcgagcggggatcatgctgcagccggttctcccggacggtgcggctgtcatagttggcatagcagtacagacattcatgtccgcaggtgttataagcaccgatgtctgcgccgagcaggcaggagcactcacctctcgcccgtttctgctgtggcaccttcaatctgcacccgatggcacgttccaatacagactgcgataaacaaccgtccgcatccacattctgccggacaagactgcggttctcacagcacagatgaatctgaagatgctgcttttccgctatctcggaaaacgccgcaatcagacgctcctgctgctcctttccgacgctccttacgcccggaaagttccgcctggttttttcatataaatcaataaaactcaccacgcactgcccggtatatccggacagcttctctgcaaactccccgaacttttccacatgatactgctcggtgtaggtctcatttaaaaagacgggatcataacggaagctgacacgttctcttcccacgctctccgacaatctgcaaaatgcctccgcgacgaggttcttatcaggcacacgaggttctatctccctgccgtaaggcgtgatcgtcacaaaccagaacatgataaacgcatccagcagcggaaggcggtccagcataggcagcggatttttcgtacagaatacaagtgcatccaccaccgcagggtcgatccggtatcttgttatctgcgtgggataatacggattgcgcaccagaacttctcccgcgcggacccgctcatagaaccagtcgctgtaatacgccggtatgtctgtcctgcttcctgtattcagtatcatacccttcacctccgcatatccagattataccctattttttcctgtttttcacttctgaattttgctccccggacggatggtatccttcccgaaattgattttatgtaaaccttgacttctcctgccggcaaagttataatgttagagttgactaactcattattttacctgatttcaaaaacggagggcggttgcagcggcaaccggaaatatatgattattgaaacagctctatatcaggatgtactggaacattccagtatcttccgccaattaccaaaagataaatatcccaatgtcctgcgctgcttaaatgcgcgcgtggtcgattatccgcaggatgcatccatcgccgcactcggggattcctccggctgctccggcattctgctcaccggcatgctggaagaatatctggtcgacgaaaacgggaaccagatcatcatcaatcatctgcgaagcggcgatgtcttcggcgccgagtctgtgtgtgccggacaggtagcgagtcatgtctacattcacaccgtggaaaaaagcaagatcctgatgctcgattttgccgcgctcttgtcggaaaaaacattttcctgctcctgccgtatgcaggtcaccaccaatctgatgcaggaatttgcgcgccaggtgatgttttttaacagcaaaatacggattctcagtcagaaaaagctgcgggacaagttaaagatctatctgcagacgttagagatcgcaccggacggaacggtctgccttccttacacccgcagagaactctcggaatatctctacgcggaccggagcgctctctcccgcgaactttgcaaaatgcgcgacgaggggattctgaatttttcgggttccaggctgcagattcttgatccggattttctggcaatataatctttttttgaggcggttgcaatagcaaccgctttttctttccttttccagtattctatgtctcgttggttagttttaactaaccaataattacatactgataccgttcagagggaggaactatgataaaaaagacaaaacttaccgctgcattattgacagctgccatggtactgcagcttgcagcctgcggaagcaatgcggcttccggaacagagaatacttcagataacggagccacagcagccaccgagactgctgccgcttccgaatcggcggagagcgtagacactgaaactgctgccaccgaggacaccggcacccacaccgtggttgaccatgccggcaacactgtggaagttccgaatcacattacccgcgtggtcatcgaccagattccgattctctccacctacatgtcctatttcggcggggaagctccttatatcgtaggctactgcggttctttcaaggataccatctcaaagacggttctcaaaaatatcgcaccggagctgatggaatccgcggataccgtctatgcacagagcgatctgaatatcgaggaaatcatgaagttagaaccggatgtcatcttatacaatgccggcaatacggcacacgcggagatcttacaggagagtggcattccgtgtatcggatttgcaaccgtcggccacgagacagaagctgatccgttaaaccgctacaaacagtggctggatcttctggaggatgtcttcggtgaggaaggcagaaccgatgctttcactgctgccggcgacgagattgttgcggatgtggaggcaaggattgcaaccgttccggaggatgagcgcccgagcgcactgattctgtggaaatacagcgacggcgtaccacaggtatccggcaacggaacctttggtacctactggatgaaacacttaggcgtcacggatgttgccgcggaggcaaccggttttacacaggtaagcatggaacagatctatgagtggaatccggatattctgtttgtcgacggtccgggactcatcggtcttacctcggaggacgtgctggagaacagggtagagggaaccgatttctcctccatcaaagctgttcaggacggacgtgtctatgacacaacgctcggcatgtggaactggtttacaccaaacccggacgctccgctggtattcgcatggcttgcatgcaacacttacccggaagttttcgcagactatcctctggaggataccatccgtgaatattaccatgactggtatggctacgatgttaccgatgaggaaatggaggaaatgcttcagtactgatgaatgataattttttgatcaaacgggggcattttacaccgcttgccattctcttcatgatactgctgccgcttgtcaccgcactgatctgtatctgcctcggcagaatgaatgtgccggtcggcgacgtgatcgccgttttccgcgatgttctcacgggaaatgaaggacatgcgcagaattactccattgtaatcaatctgcggctgccgcggattctgatggcaattattgtgggagcaggtcttacctgcgcaggaaacacgttccaatcgctgttttccaatccactggcaacaccggacattctcggtgttaccagcggcacctgcgtgggagcgatccttgcgatcatcctttcctgcggtattctggagacacagctcattgcacttgcgttcggacttgcctccgtattttttacgttaaagatcgcaggaaaaaatgagaaccgccaggtggtctatcttgtgctggcaggcgtgatcgcctcctccctgtttaacgccatcggctctctgctgaaatatactgccgacccacaggacaagcttccggaaattacttactggctgatgggcagcttcacaagcgccacttataaaaaattgctgatcggttctccgctcattctcattggaatcgtcgtcatctatctgctccgatggagactgaatattttatccttaagcgaggatgaagcgaaagccagcggcatccacttaaaacggacacagatgatattcatcctggcgtcgacggtcattaccgcctcggcggtatccatgtgcggtcaggtcggctggatcggtctcttagtcccgcactgcgccagaatgcttgtcggaagcaacaaccgttatgtggttcccatcagcttaagtctcggtgcaagctttatgattctgattgacacactttcaagaaccatcagcgtcatcgagcttccgctgtccattctgaccgccatcatcggagcaccggtctttatttcactgctgaataagaacaggagcaatctgcaatgattcttgaaataaaaaatggctgttttggatatcccaaacaggatataatattacctgatatcaatctctcattagaggaaggtcatattttagcaatcttaggtcccaacggtatcggaaagaccacactattaaaatgcatgatcggtctgctcccctggagagagggtgcgacttttctgtacgggcaggacatcaaaacattaaaaccaaaggaattgtggagcaatgtctcctacattccgcagagccacggttttgctttttcctacaccggactggaaatggttatgctcggccgctgttcgcatcttggcgtttttgaacagcccggcagacgggagattgagatggcggaagccatgatggagaaaacaggcatcacgcatcttgccaaaaaggactgcaaccgcatgagcggcggagaacttcagatggtactgattgcgcgcgcactgatcaatgaaccgaagctgatcattctcgacgagccggaaacaggtcttgattttcacaatcagattctggttctcaacatgatcgaccggctctcccacgaggacggcatcagcgcaatcatgaacacgcactatccgaccaacgccatgtctgtcgccgacgaggcttttatgatgaatcacaaaggcacttttttctacggcagcacggagaaggttctgacagaaaagaatatttccgtgtcctttgacgtcaatgtggttgtcaatgagttcagccatcatcaaaaaaaataaagagcatcgtacctgtctccctgacagacaaagcgatgtgacagaaaggatctactatgtcagaaggcgtatttaccatcgcagcaaagcgtccgatccgcgaggagatgaccatctcacgaaataccggactcggcacttccaattccgctacctggttttccctgggcgcaggcacatccatcacaccggaaagctacgatacgatgtccatctatatcggagctgccggcaccggaacgtttctcatcggtgaacagccggaaacaatggatctgcacccggatgagatattgctcgtaccggagagaactctctgtggtgtcaaaaccggcgagggttgtatctatacagaaattattacaaaaaaggagaacactatgaacgatcttgtaaaaacaaaagaggtattgaatctgaaggaactgatctcttacgaggagggaagcattgcaaacgtggatatcgtacacaacgacacgatgaagtttgtcctcatggcattcgatgagggtaccggactgacaccacaccgcgcaccaggcaacgcaatcctgaccgcgcttgagggtacagctgtcatcggatacgagggtaccgactataccttaaacgcaggtgagagcttccgttttgagaagaacggtctgcacagcgtaaccgcaaagggacgtttcaaaatgtctctgctgcttgttctggaataagaccggaagaaaaaagagccgaaaggctcttttttgttgcaggaaaatgacccgctacatttcttctaatgtgtgatactgtcggattgctgtctcgtagaggttgtttccctcgcggtcgatcacgacgataaccggaaaatcttttacctcgatcttgcggattgcctccgcgccgagatcctcatagcatacaatctcagattttgtgatgcatttggaaagcagtgcgccggctccgccgatggctgcaaaatagacggcgtggttgcggatcaccgcgtcaatcacttcttttgagcgctttccttttccaatcattgccttttcaccgagatccaacagtctcggagcgtatttgtccatacgggtggctgtggtcggtccggcagatccgatcggacgtccttccctggcgggagacggtcccatataatagatcgtcgcatccttgatgtcaatcggaagctcctcgccccggtccaatgcctcgatcatgcgcttatgtgccgcatcgcgcgccacatacatggttcctgtcagatagacatagtccccggcttttaaatctctggtaacctcttccgtaattggtgttgcaatatgtttatccatatcttttcctctcatcatcctgcttatcaacatttcattttctgtttgtggaaaacccggcatattttctcttacagtgttcttacaacgtgccggttcacgtggcagcagatattgacagccaccggaagtcccgcaatgtgtgtcggataggtattgatgttcactgcaagcgccgtcgtcgttcctccgagtcctcccggtccgattccaagctgattgatctttgaaagcatctcttcctcgagatctttgacataggggatatcggaatgttcatcgaccggtctcgtgagcgcctgcttggcgagaagcgcgcatttttcaaatgtaccgccaatgccgactccgacgaccatcggcggacatgcattcggccccgcatcctttacggcggtaagaatcgcatgcctgactccctcgatgccgtccgccggttttaacatgaacacgcggctcatattttcactgccgaatcctttcggcgccatggtgatctttacctgatcgcccggcacgatggaataatgaatgactgccggcgtgttatcttttgtattttcacgaatgagcggatcaccgacaacggatttgcgcaggaatccctctgtgtatccctgacggactccctcgttaacggcatcctcaatcgctgcgccctcaaaatggacatcctgtccgacttccagaaagatcactgccattccggtgtcctgacagatcggaatcatctcctcgtccgcaatctttaaattgtcctgcagctgatgtaaaatctttttcccgagttcagactgttctgtgtcagcggcatgcttcatcgccgcatccatatccgcggacagataatgatttgcctgtatacacatttctttgatattttttgtaatctcatctgtttgaattgttcttatcataccgttcttcctctccctgtctgctgtatatgtggcgtttaggatgcctgatcttttttgttttcgtctttctttttgatattaaagtgaatcttgaatttttccagcgtctcgttgttatcccgcgacttcatatccgggaatgccttcatcagacgctgaaaaccaaagcttttctcctcgtacagcttctcgtagcgctccataagttctgcacgctcgcgctttttctcctcgagtgcaagttcgcgttcgcgctttttctcctcacgggaagctgcataattctctgccttctcggcaagcttgttcttcgctgtctgcggcagttccgaaatactctccttggtctctgaaagcttatccttcgccgctcccgtcgtctccgcaagcttatccttcgctgcccctgtcgtctccgcaaatttatcctttgctgctcccgtcgtctccgcaagcttatccttcgccgctcccgtcgtctccgcaagtttatccttcgctgtctgcggcagcccgtaaatattttccttcgtctcgctgatcttatccatcagctccacatgtgttttctggaatttctcggatttttcaataacgtctgtcacattttcatagatattttcgccgatctcatcggacagccggtgaatagacgccgccatctcatccatgacctttaagcgcttattgaatttcagaatcgtcgtgaccgtgatgatgcagtctgccgcgaacacgcacatgataatactgagcagcactacgccaagcacgaacggaataaagcgtatggctgcataaatgatcggatgaatgatatccatgataaaggtacatgccagtccccagtagatcgaaaacttcaggcagacgtaacctttgatgttgaatggcttgtcagaatagtcccaccacttgttgtgaaatactttttccagaatataacccgtaatgtactccagcacagaggtaagaagaaaagatcctgcaaacaggatcagcagattttctttcagaggtgtcaggatggccaccacaatcaccacgccgcacccgtagatcggacagtacggaccgttcaaaaatccacggttcacgaactttccggtatcgagtgctgcgtaggatacctcggtacaccagccgataaatgcatagataataaaaatccagaccagttcataaaaattctgcggcataatcattctcctttgtcccgtgctttctccacgtactcataagaatcattatagtccatagaattttatgaaacaatcctatattatccgatttctccgtgtttttcgtaatttgtcacctttgtgactttatttttctcatccacgaaaagcaccgttggacgaagctctgatgcttcctccggcgtcacctgcgcgtatgccatcagaataatcttgtcgccggtctgcaccatgcgtgccgccgcaccgtttaagcacatcacgccgctgccgcgctccccggcaatcgtgtaggtctcaaagcgggagccgttgttgacatccacgatctgtaccttctcgtattccaggattcccgcctgctccagcagatccatatccacggtaatgctcccgacgtagtctaattccgcttgtgttactgttgcgcggtgtatttttgcttttaacattgtaattgtcatcgcttagttctccaattcatacataaaattatcgatcagtcttgtctttccgatatagactgctatcgcggcaaggattcctctgtcgatcttctccacctgctgcatcgtgtcaagatctacgatttttacataatcaatctttgcaagcggctctttttcaatctccgctgtcattgaggcaagaatttttttgcagtcgcgctctcccttttccaccatctcttttccgaggaagatggaacggctcaacacaagcgctgccttccgctcttccggcgacagataggtgttacgggaactttttgcaagtccgtcctcctctcggatgatcgggcagccggtaatcgtaagcggcatgttcagatcttttaccattctcttgataaccgcaagctgctgcgcgtctttctgtccgaaatatgcgcggtccggcgtcacaatattgaaaagcttcgtcacaaccgtgcacacgccgcggaagtgtaccggtctgctgagtccgcaaagctccttggtcagtacatccatatcgacataggaatagaactgatccccgtacatctcctccggcgttggatggaaaatgagatccacgtcgtgctcctcgcagagctttgcatcatgtttcagatctctcggatagcttgcgagatcctccgtcggcccaaactgcatcggattgacaaaaatactcacaacgactctgtcattctctccggctgcatcgatcaaactcatatgtccctcatgcaggtagcccatggtcggcacaaaaccgatcgaaagtccttcctttttccactcctttacctgtgctcttacttcttctatggttgatacgattttcataatctgctcctttcgccattttttatatttagtataatttatcaatcaccgagtcatcgatcttaaagcaatgttcctcgcccggaaatgttccttcttttgtctctttgatatatgctttgacgccctcgcgcatcacctcgccgacattcgcaaataccttcacaaacttcggacggaaatcgccgtacatggcgagcagatcctggtagacgagcacctgtccgtcacagcctgctcccgcaccgataccgatggtcggaattgtaagttcctctgatatcttagctgccagcttcgccggcacacactccatcacgaccatgcaggcacctgccgcttccactgcttttgcatcagccagaagctttttcgctgcctccacatcttttccctgcactttgaatccaccgaatgcattgacagactggggggtcaatccgatgtgcgccacaaccggaatggatgccttcacgatcgcctcgatgtgaggtgcaaattccacaccaccctccagctttaccgcattcgcgcggccttccttcatcagtcttccggcattgaccactgcgtcgtacacggatgtctggtaggacataaacggcatatccgcaactacaaatgcatcttttgcaccgcgggagaccgccgccgtgtgatgaatcatatcttccatggtcacagagagcgtatcctcatatccgagcattaccattcccaatgaatccccgacgagaatcgtgttgacaccggcttcatccatgatctttgccgtcgtgtaatcataagccgtcaccatgacgatcttatcgtgttcttccttctgcttctgtaacgtcaatactgtgtttttcatgtttccctccacttttcctgcgccccaggcgcatagactgtgttttcatgtttacactgtttccgcgcattccgcgcccgggctgtgttccccgtctctgcacaattttctcatctccgtgtaatcacgatccggatgcttgctctgtgcgaaatctgtgagatattcagcacaggaagtatatattttccgctgtttttcatttaacgcggaaatatgtttttctacggtagcacagtcatttctctccagcggacctgtgagagactgcacgcatccctgtgtcagaatgtgatccagatttccctttgcaagtgcatagagctcgcttcgcgcttcctcctgtgcgaatccgcagtcgagaagcagctgctcggacatggaaaataaggcagtcatatagttggatgagattgctgccgccgcgtgatatttgattttgtcttctttggaaatgatacgggtgcgattgcccatggaatggaaaaatgtctccagatccttcacataggaggagtccccctcgagtgtgaacaatacgccggataattctctccatgcattttctttgctgctgattgcagcaagaggatgtacggaacatgcatgacagttcatgctgtcccagtctgaaaagatgtctgaactgtaaagaccgctgcaatgaccgatcactttaccggatacatagggctttgcctgctgccacacttctgcgatggcggaatccggtacagtaaatagaatcatgccgcaactgctgatgatttcttctaaactttcataacaggttgtctgtgtaaatgctgctgcccatgcagcagacgcgcgggtcaggctgtaataacctcctacgttcctgcccttttctttaaaatatttgccaagtgacacgccgaccttgccggcaccgataaaaccgatctgcatacgttcggtctgtacatcattcaatgaaatacaaacgcctcctcccggaagcagtatgcggcacctttcctgtgaaatcatggtctcctcgatccacgtcccgtcggaaactggcggtctaaggttcgttctcttttcttctacggtatcatttccgcgctgcggaatatcatccgtgatttactataacacctggtatttcaaatgtaaataaaggaataagaaaaacccgcggtcttttgaccgcgggttccgatacatctttaatttttagttgtttcccttataagacaggaattttacaactgcaatgatcgggatcagaccggatacacagccgattgcctgtgtctcgctctcctgcttaccctctaactttgcatacatcttagcgtagctgcatcctaagaatacaacgtttaatacgattgtgatgacattttctaccgtgccgtttaccgggatgaataacagtgcaaccggtaaaatccaccagagcttgaataccattgccggaagttcaaggcttccaaataactttaccttctcgccttccccctctgctgctgcatccgcacatgcataaaatacaccgtatggaatccatgcaagccatgcatttttgtatcccagtgcctttaatgccttcatgtgggaaactgcatataacacatagcatgctaccacaacaacaagacataacagaatgacaccgatgcttgctccaagaattgctccataagtactcatataacctgttcctccttaatagtaaaatctctcttcacactctatcatatagaaaaggctatacgatgtcaaatatatctttatatttttttatactttttatttttcttttatttttagaaaaatgcttattccttgtcactgtcatctctggcatcgtcttcggcacgtttcaacagctcttccatcagctcatcatccgtctcggaattatccgcttgaccggctgctttcttcgcattttctgctgcaagagccgcgcttgccgcctcttcctcatcggtcagaagctcagaagtatcggctgtctcaagctccttattttcgcgcaccttcgcaatgcttgccacagtcacattctcgtccagattgatcagcttgacaccggaggtaatacgtccaagaagtgccgtatccgctaccttaatgcggataatgataccctctgtcgtgattaacattatttcattgtcatggttgactgccttgacaccgacgatattacctgttttctcggtaatcttgtagcacttcacacccttaccgccacggttctgtgtggtaaactcggagattaacgtgcactttccgagacctttttcggaaacgatcatcagggaatctccttgggattccatctgcatgccgacgacctcatctccgtctgtcaggttcataccaatgacgcccatggatgttctgcctgtttttcttacgtctgtctctttaaaccggatacactgtccgtatttggtgacaaggaaaatatcctgattattatcggtcttcttcacctcgatcagctcgtcgtcctcgcgcagattgatggctgcaagacctgtctttctcacatttgcataatcggtaatcggtgtcttcttcacgatacctttctttgtcgccatgaaaaggaaatgtccctcggtgtactcccgtatcggaatgaccgcagtaatcttctcgcccggctgcagctgaagcaggttgatgattgcggtaccgcgcgcggttctgcttgcctctggaatctcataagccttcatgcggtatacacggccggtattcgtgaagaacatcaggtaatggtgcgatgtcgtcatcagaagttcctcgatgtaatcgtcatcaatggtctccattcccttgattcccttgcccccgcggttctgcgcacggaaattgtcaaggctcatacgcttgatatatccaagcttcgtcatggtaatgacggtattggtaaccggaatcaaatcctccatggaaatatcatattcgtcaaaaccgatggatgttcttctgtcatccccgtacttgtcggcgatcagaagaatctcctcacggatgacgccgagcagctttttcttgtcggcaagaattgccttcaactctgtgatgcgctccatcaattccgcgtattcgttctccagcttctcgcgttccagacctgtcagcgcacgcagacgcatatccacgatcgcctgtgcctgtacgtccgtcagcgaaaaacgctccattaagcggtcttttgcttcctgggtgttcttgctgctgcggataatgttgataacttcatcgatattatcaagtgctgttaataatccctgtaagatatgggcacgttcttccgccttgttcagatcatatttcgttcttctggtgacaacttcttcctgatggatcaggtaatagttgagcatctcgtaaaggtttaagaccttcggctgattgtcgacaagcgctaacatgatcacaccgaacgtatcctgaagctgtgtgtgcttgtacagaaggttcagcacgacattcgggttcacatcacggcggagttcgatgcagattctcataccctgacggtcggactcatcccgcagatcggtgatgccgtcgattttcttatctctgacaagctccgcgatcttctcgatcagacgcgccttgtttaccatgtacggaagctctgtcacaacgatgcggttcttgccgttctgcatcggctcaatgctggtcaccgcgcggactctgacttttccgcgtccggtccggtatgcctcgttgattccggcggttccaagaatcgtacctccggtaggaaaatccggtcccttgacgatcgtcaaaagctcctcgatatcggttccgcggtcttccaacacctgattatcaatgatctttaccacaccgttaataacctcgcgcagattgtgaggcggaatattggttgccattccgacagcgatacctgtcgtaccgttgactaacaggttcggaaaacgggacggaagcactgtaggctctttttctgtctcatcaaagttcggaacaaaatcaaccgtatcttttccgatgtccgcaagcatttccatggaaatcttggaaagtcttgcctcagtgtatcgcatagcagcagcgccgtcaccatcgacggaaccaaaatttccatgtccgtcgacaagcggataacggaatgaccagtcctgtgccatattgacgagtgctccgtagattgagctgtcgccgtgcggatggtatttacccatcgtatcaccgacgatacgcgcacatttacggtgcggcttgtccggtccgttgttcagctcaatcatggaatagaggacacgcctctgtaccggcttcaaaccatctcttacatccggcagcgcacgctgtgcaatgacactcatggcatagtcgatgtaggaactttccattgttttcttcagatccacatcatgtatctggtcaaaaatcttgtcatccataggatttttctccatttctatcaattacatcatactctgtacagtccgtctgtcagatatcaagattctgtacatactttgcattttcctcgataaattcacggcgcggctctaccttgtctcccatgagcgtcgtaaatgtcacatcaatctcagaagaattctcttcatcaatcatgacacgctttaagatacgcttttccggatccatggtcgtctcccagagctgctcagcatccatctcaccaagtcctttgtatcgctggatcttgttgttgccgtcgcggccgatctctgtcagaatactgtttaattcattatcgtcgtacgcataccacacgttcttgttcttctcgatcttatagagcggcggagtagccagatagacatgtccctgcttaatcagctccggcatgaagcggtacaaaaaggtcagcatcagcgtcgcaatatgtgcaccgtcgacatcggcatcggtcatgatgatgatcttgttgtagcggagcttgctgatatcaaaatcttcatgaataccggtaccgaacgcagtaatcatcgctttgatctcagcattgccataaatcttgtctaatcttgccttctccacattcaaaatcttaccgcggagcggcaggatcgcctgcgttgcacggcttctcgccgtctttgcggaaccgccggcggaatctccctctacaataaagatctcgcagttcttcgggtctttgtcggaacagtcggcaagcttgcccggaagagacattccctcgagggcggtctttcttctggtgagatcacgcgcttttctcgccgcttccctcgcgcgctgcgcgagcagtgatttttcacagatgttcttcgccaccgtaggattctgctccaggaagtaggtgagctgctcgctgacaaccgagtcaacggcgcctcgcgcctcgctgttgccgagcttctgcttcgtctgtccctcgaactgcggctcctcgatcttgatgctgatgatcgccgtgagtccctcgcggatatcgtctccggtgagcgccggctccgtatcctttaaaatcttattcgcacgcgcataggtattgaaagtcttcgtcaatgcattacggaaaccggcaagatgtgtaccgccttccggtgtgatgatattattgacaaagctgtaagtcgcatcattgtaggaatcgttgtgctgcatggcaacttccacatagactccgtccctggttccctcgcagtagatgacttccggatagagcgcttccttgctcttgttcaagtaggtcacaaattccttgataccgcctgcatagtggaattcgtgtgtatgcaccggatccactctggcgtcggagagcacaattcttaagccttttgttaaaaaggcggtctcgcgcagtctctgttttaacgtatcgtaatcatagacggtttcctcaaagatcgttggatccggatggaaggtaaccttcgttccgtgtttttcggcagaacacttaccgataaccttaacaggttcatccggcttgccaatcttataactctgactgtaaatctgtccatccttgtatacctcaacagaaagcttcgtggatagggcatttacaaccgatgctcctactccgtggagaccgccggataccttatatccgccgccgccaaactttccgccggcatgaagcaccgtgtatacaacctccagtgcagactttccggctttgtgattcatcccgaccgggataccgcgtccgtcatcctccaccgtgatggaattgtccggattgatcgtcacttcaatatttttacaatatccggcaagcgcctcatcaactgcattatctacaatctcatataccagatgatgaagtcctctcgcagatgtacttccaatgtacattccgggtctttttctgactgcctcaagtccctctaatatctggatttgatctgctccgtattcattttctgtacccattttattctccatttctgcatcagccataaaaacggctcacgcttactatattgatcgctcatatacatgaccggctatgacttcaaatacccggtttaccgtaaaacgatttctcacaaattcatccagtcccgtacaggtaatgatggtctgcgtatcggaaatattgttcagcagataattctgacggctgctgtcaagctcagataacacatcatccagcagcaacaccggcgtatcggaaatggacttcctcacaagttcaatctcggacaacttcagcgacaacgccgatgttctctgctgtccctgtgaaccgtactttcggatatcgacgtcaccgatcgagaacagcaggtcgtccctgtgcggtcccaccgatgtctgacaaagctttttgtccttttccttcgccctgctaagttcatcttcaaaaaagatatcgtcgatattcggctcatattttaaaaaaagctcttcctttccgccggaaatgcggtagtgaatgtcacttacaatctcccggagttcatccacgaactgttttctgcgtcggatgatcttcttcccggtctcaatgagctgcatgtcccagacaggcagcgtatcggaaagacttggccggtagatcatgtcttttagaagcttgttgcgctgcgctaagattttattgtaatttgtgaggtctgccagatagatccgatccagctggcacaattcggaatctaaaaatctgcgcctctccgccggaccattcttgataatattcagatcttccggtgaaaaaaacacaatatttaaaattccgaaaagctcactggcttttttgatcggaatcttgtcgatggcaatccccttggcgcggttcttcttcagatgcatatcgatctgatattctctcccaccgcgcacgacaaccgttttcagatgagcttcttcctcaccgaaacggatcatctccctgtcacggcttcctttgtgggacttggtcgttccgctcatatatgccgcttctaagatatttgtcttgccctgcgcattatccccgaataaaatattggttccttcatcaaaagaaatctctaaattttcgtaatttctgaaattcttaagctcgattgaccgaatgttcatctgactatctttactgtctcgccattataggaaacaagttcaccgccgtgcagcttttttcctctctgcgtctctacttccccgttcacagttacaagtccatcctggatcacgaacttggcatccacaccggactccacaagcccggcttttttcagtgcctgtcccagtttgatgaattcatcctctttgcgaatctctatttctatcatctttctcctacgcctcgtttctaaacggtgctggcattaaagttcaccggcagtatcagataaatgaactttccttcatcatccttgataaaacacggtgcctttggattcaccatataaaggcttacctcctcctcatcgatcacgcgaagcgcgtcaatgaagaacttcgggttgaatccgattaaaatatccttgccatcttttacaatatcaatatcctcattcatagaaccgatgaaggaattgatctttaactccatgtttccgtctgtcacattcatgatgatcggctttttgtcaccctctttgacgaggagcgtcgcacggtcgatacagtctaacagctcacgcttgttgatcttgacctttgtctcataatcggaggagagcatctgctcgatcttaaagtattcaccctcgatcagtctggaaacgacagtcgtatcatcaaattcaaatacaatgtggttgtcggtcaggaacatattgacatcttcctccgcgcttcccggaagaatcttgctcacttcctgcagcgtctttccaggaacgacaaccttcttgtgctcatagttattctttaactcgatgttgcggatggaaatacggtggccgtcgagagataccactttcaaatgattctcctcgatctcaaaaagctctcccgtcattaacttgttattgtcgttgtccgcgatcgagaagatcgtctggcgaatgacttcttttaaagtgaattgagataacgtgatggcttcatttctctcgatataaggaatataggaaaaatcatctccggattttcctacgatattgaactttgctttttcacaggtaatggtcgtcttaaaggaagcgtctgtctcaatcacaacatcactgtcaggaagctttctcacgatctcggaaaatatcttggcatccagagcaatcactccgcgttctgcgatctcaccttcgatcttcgtctcgattcccaattccatatcattggcagttaatttgatctcattggcagaagcatcaatcaggatacactccagaatggccatcgtggttctggttggaaccgctttcgatacgatattgacaccgtgcagtaaatttgatttggaacagatcagtttcatagttgttaataactccttcctgtggttcgtggaatatatggtgcgcacgccatacatgattgttataaaaagagattcaaagtaatattcttagggggtgtttatatgtgaataagtcacacagcccttgatctataagactttcaggtaaaaaatgaagggtgaaagtctgtgaattacgtgcggatgaaatctggacaacctgtgaataaaaaattatgtaaacttgaaagaaaaatgtgaaagaaaccttaagtggtttacataatgatatttatccagtttcatgaacaaaccttacacaatatttcaacaaccgaatgtgaatatctagttcgggttgatctttttcttgatggtgtcgatgagactgcgtgtcgtctcgtccgactcgtactcatccgaaatcttctggacgccgtggatgatggtagagtgatctctgccgccgagcagcgcaccgatggaatctaacggtgtgtcggtcatattcttacataaatacatggcaatctggcgcggccttgcgatgtctttgctccggttcttggagatcatctgatctaaggagatctggaaatgctccgatacgacctcgataataagctgaggcgtaatctccttcggcttatccggagtgatgatattctgaagctccttctgggcaatctccattgtaatgtccgttttctcaaggttggagtaggcgagcagtttattgagcgcaccttccagctcacggatgttggacttgatgttggttgcaatgtaattaaggatctcgtcgcttaagttcatttcatccgcttcgatctttttgcggagaatcgccattcgtgtctcgtagtccggtgttccgatgtcagccatcagaccccactcgaaacgggaacggatacgttcttccagtgtctccatctcttttggcggcttatcggatgtaagaataatctgtttgccggcggagtggagggcattgaacgtatggaaaaattcttcctgcgtactttccttacctataataaactgtacatcatcgatcatcagaacatcgatggtacggtatttttcacgaaacttgttcatcgcggctgcattaccgcttcggatggactcgatgacctcgttggtaaattcctcggaagtcacgcagataatcttcgcatccggattgcgctccaggatgaaatgaccgatggaatgcatcaggtgcgtcttgccgagtcccggtcctccataaatatagagaggattgtatgcctcgcccggagattccgcaactgcgagagaagcggagtgggcaaaacgattattgcttccgacaacgaatgtatcaaacgtataattggaattcagattcgatttggatgccgcttctgagtaaaaaggctttttctgtttattaggagaagaagcgatcgacttcgcctgttccggaagaatgaacttgatctcgtattctgttccggtgatctctgtgattgctactttgagaggcagatagtacttcttggaaatatagctgagtcccaactgctcggacgggacaaggatatatgcggtgttcccagtgacaccataaaattcaaggggacgtaagaatgtgttaaaagcaatgtcgctgatgtcgtgttctgtcttcacggtcatcaggatctcgtcccatttttctaaaatctgatccatgtaaacgctccaatttcttatcatactaaaaaaaatcctacaccctctatcctacaccattttagtgctttaatcaatgtttaatttgctttggagtgctatggcgtaggggaacactttaaaagaaaaaaaacgctatttgggcaaaatacggtgtctatgagggaaaaaaagtgatgtcatgttatagaccgccaaaaatcagcgtttgtgatgcttattcacaacttgtccgtgtattatccatgttttatccacaagttatccacatttcggggataacttatgtcaacggcgtatttaagggatttccgggatccttaattttacttttttttgtggaatggttgtggaaagcaattttacaagatatagttggcatgagtttcttccttatatatatagtggttatttttttccacaaagagcagattgtggaaatgtagatgaattctgccggccgggattattattttatgcttgacttggagactttttctgatataattgagaatgatgttttgtaacgtagaggaggtgaatgcgatatgaagatgacattccaaccaaaaaagagacagagagcgaaagttcacggtttcagaagcagaatgagcacagcaggcggaagaaaagtattggctgcaagaagattaaaaggtagaaagaaattgtcagcttaggccacatcttatgtggtcttttcttctataaaggacatgcatacagaatgaaatattccgagtcattgaagaaaaccaaagatttccagaacgtataccgcaggggaaagtcatatgcgaaccggtaccttgtgatgtacgttctttcaaatcagacagaaggaaatcgtttagggatttccgtgagtaaaaaagttggaaacagtgttatcagacatcatctgacccggctgatccgggaaagctacagactgcatgaagacatgttcaatagtggtttggacattgtagtcgtcgcaagaagcacagcgaaggacatctcgtatcatgaagtggagagtgcgctgctgcatcttgggggtcttcacaagatcattagtaaagaaaagaagatggaatcattttgaaaaaaattttgatcgctttgataaaattttatagaaaatatctttctccgatgaaaacgaccaagtgtccgtattgtccaacctgttcgttgtacgggctggaagctgtcgaaaaatacggagccatcaagggcggcacgctggctttatggagaattataagatgcaatcctttttcaaaaggtggatatgatccggttccatagtggaggtattttaagtgtcagaaatgttattaacagcgtatgacggtgcgattctcggaccaatcgcaaaattacttggatgggtaatgaatggagtctactatctgatggatcagattggaattggtaatgtaggtctttccatcattatatttacgattattatttatcttcttctgttcccgcttacttataagcagcagaagttctcaaagctgtcacagaagatgcagccggagctgaatgcgattaataaaaagtatcagggaaaaaaggatcaggcatccatgatggcaatgcagcaggagacacaggctgtctatgagaagtacggtgtttccatgatgggaagctgcgtacagatgctgattcagatgccgcttctgtttgctttgtatcgtgtattcatgaacgttcctgcctatgtaagcggtattaagaatttgttcacacagccgcttggcggcaatgcaacatccctggtagacggcatcatggcgacagagggatatcaggataccatgaccaatctggtgtctacacttaagatcacgacacagccggtagctaattttactgtttcggatccgaccgcgattgccaactcgatcgtggatgttacttataagatgaactccagcggatgggatgcgttaaaggatgcattcccggctctctccagtgagatttcatccacctatgagacggtgtcccatgtaaataatttctttggaatgaatatttcagatacaccgcttcatgtgattacatcaagtttttccgcaggtgcttaccttatggtaattgcagccttgctggttccgattatttcttatctgacgcaggtattgaacatcaagttaatgccgcaggcgactgcaagtggcaatgaccagagcgatgcgatggcacagcagatgaagatgatgaaccgtatgatgccgttattctcactggttatgtgttttaccgttccggtcggtcttggtatctactggattgccggtgctgttgtccgtgttgtacagcagtatttcctgaacaagcatttcgagaagatgaatcttgaagatattatcaagaagaatcaggaaaaggcgaagaaaaagcgcgagaagatgggaatcgccgagaaccagatttccaatgctgcaaaaatgaataccagacagatggtagatgcgaataagaagcagttgagcagtgcggagaaagagcttgagatcgagaaggcgaacgcagcgaagtcgaaggcaaaagccggaagcatgagcgcgaaagcaaatatggtacgtgagtttaacgagcgcaacaacagaaagtaagtttcggggtggagtaagttagaaagggtatggtgatgaaaatggattatattgagatttcagcaaagacagttgatgacgcaatcacagaagccatcatcaagctggggacaacccatgacaagatcgaatatgaagtaatcgaaaagggaagcgcaggtttccttggaatcaacagaaaggacgctgtgatccgcgcccgcaggaagaatgatacgaatgataatatccgtgatttccttgagagcgtatttaaggcaatgggacttaccgtcacgatccagatcgagaaggaagaggacagcaatgtcgtgaacgttgacttaaagggagacgatatgggtgttctgataggtaagagaggacagacgctggatgctcttcagtacctgaccaaccttgcagtgaacaagaattccgaggagtatgtgaaggtcaagatcgatacggaggattaccggaagagaagaagagagacgcttgagaatcttgctaagaacattgcttacaaggtgaagagaacgaagcgcccggtttctttagagccgatgaatccgtttgagagaagagtcattcattcgactttacagaatgataagtttgtgacaacgcacagtgagggtgaagagccttacagacatgtggttgttaccctgaagaaatagagtacaaaatgggggtgtcgtccgacatccccattctttcattaaaggagatttatgaaaacagatactattgctgcgattgcgactgccatggcaggatcgggaatcggaattgtcagaatcagcggggaagaagcggtttccattacagatcagatttttcatatgccgggcggtaagaagctttcggatatggagacacacacgattcattacggacatatccgggatggagaggaagtcattgatgaggtgatggttttactgatgcgcggaccgcggagttacaccagggaagatacggttgagattgactgccacggcggtgtttatgtgatgaagcgcattttggagacagtcatcaaatatggggcgcgtcctgcagagccgggagaattcacgaagcgtgcatttttgaacggacgtattgatttgtcccaggcggaatctgtgatggatgtgatttcggcgaagaatgaatttgccttaaagagttccatgaaacagttatccggcgctgtctcagatgcagtcaaagagattcggggagagattctccacgagatagcatttattgaatcggcgcttgatgatccggagcatatcagcctggatggttacggggagagactggagcttaccatagagggtgcagtggacagaattgagaagctgttggcttccagtgataacggccgcatcttaaaagagggaatttctaccgtcattgtgggaaaaccaaatgccggaaaatcgtcacttcttaacactctattgggcgaggagcgggcaatcgttacagaaattgccggtactacaagggatgtgcttgaagagcagattaacctgaatggaattgtgctcaatatcatagacactgcagggattcgtgatacggatgacattgtggaaaaaatcggagtcgacaaggcgcggaagtatgtgaaggatgcagatctgattctgtatgtagtagatgcctccacgaatctggatgagaacgacggggagatcatggagctgcttcacggaagacgcacgatcatacttttgaacaaatcggacttaacgccgttgacaacagcggaggatattcgtgcacatgtggataaagactgtccggttatttctatttcggcgagagagcagaagggaatcgatgtctttaccgagcagatccgggaaatgtttttccggggagaagttacctttaatgatgaagtctatattacgaatattcgtcataaaaccgctttacaggaggcactttctagtttacatttagtagagcagagtatcgcggatggaatgccggaggacttttactcgattgatctgatgaacgcgtatgaggtgctgggaactatcatcggggaagcggtggaagatgatctggtcaatgagatattcagtaagttttgtctgggaaaatagttggcctaaatatttaagaaaccattggacagctattattggaagtatgcaaccataggataaggaggaagcagcgatgattcgacatatctgtatgtttaagctgaaggatgaggataaggaagcaaatttgaaggaggcactgcgccgtttggaggagatgagagagattcctctgattgcaacgtttgaggttgtgacgaatgcggctgctgctccggacagcaattatgatctttcacttatttttgattttaagaatatggatgatctgaatgcatatcagaagcatccgatgcatgtggagtttggtaagtttattacagcaatcagagagagcagggcttgtattgattatgaattctaagaatcttttggaagaaacgtatgatgtggcagttgtgggagcgggacatgcgggatgcgaggcggcgcttgcctgtgcgagactgggacttgagacaattatttttactgtgagtgtagacagtatcgccttgatgccgtgtaatccgaatattggtggaagttccaaggggcatctggttcgtgagatcgatgcgcttggcggccagatgggtatcaatattgataagacgtttattcagtcgaaaatgctgaacaaatccaagggacctgcggttcattcattgcgggcacaggcggataaggcaaattacagcatggagatgcggaatacattacagaatacggagcatctgacgatccgccaggcggaggttgccgagattctcacaaaagagggcgatcgtgagcagattaccggtgtgaagacagtttcgggtgcaacgtatcactgtaaggcggttgtactgtgtacgggaacctatcttcgcgcacgttgtctgaccggcgagatgattacctataccggaccaaacggtttgatggctgcaaatcatctgaccgactcgttactggcacatggagtagaaatattccgctttaagaccggtactccggcaagaattgacaaacgttcgattgatttttccaagatggaagagcagaagggagacgaaaaagtcgttccgttttctttcgtgacgaatcccgaggatgtgcagatcgaccaggtgtcctgctggctgacttacacaaatgagaaaacgcatgagattatccgcaataatctggaccggtctccgatctatgcgggaatcatagagggaaccggaccgcgttactgtccgtccattgaggataaggtggtaaagtttgcggataaggacaggcatcagattttcattgagccggaaggacttcacacgaatgagatgtatgtcggaggaatgtcctcatcacttccggaggatgtgcagcatgagatgtaccgcaccctgccgggactggagcatgtgaaaattgtccggaatgcctatgcgatcgaatatgattgtattaatccgaaccagctgtatgcatcccttgaatttaagaagatccggggacttttttccggaggacagttcaacggcagcagcggttatgaggaggcagcctgtcagggactcattgccggtatcaatgcggcgatggagattctcggaagagagccgctggtgctggaccggtcggaggcttatatcggagttctgattgatgatctcgtgacgaaggagaatcatgaaccatatcgtatgatgacttcgcgtgcggaataccgtctgttgcttcgacaggataatgcggatctgcgtctcacgaaaaaaggatatgagattggtctgatctcaaaagagcggtacgactgggtctgtaaaaaagaacagatgatcaaagaggagattgaccgtgttgcgaaggttcatgtaggtgcgaacaaagaagtgcaggctcttctggagagttacgggagcataccgttaaataccggtgtgacgttaacagaactgatccgcagaccggagcttgattataataagctggcgccgattgatcacgagagaccggtgcttccggaagaagtgagagaacaggtcaatattctgattaagtatgacgggtatatttccaggcagatcaagcaggtggaaagctttaagaagctggagaagaaaaagataccggaaggattcgattatgatgaggttccgagtctgcgcattgaggcgcggcagaagttaaagctgtacagtccgacgtcaatcggtcaggcgtcgcgtatctccggtgtatcgccggcggatgtttctgtattgctggtgtacatggaacagatgaatcatcatggggaacatcattcataggagtatcattcataaaaagaaaaacagcgcagaaatggagatttgtgttttgcacaaacttgatatgcgcttaaaaacagtgcaggaatggagaggtggtttatggcgtataatcttgaaaagttcaaaaaaggcctggatgatttgcagatccatctggacgaaaaacagatgggacaatttctaacctattatgaacttctggtagaaacgaataaagttatgaacctgaccgctatcacagagtttgacgaagtaattgagaagcattttcttgacagcctttcgttgtgtcgtgtgaaggatttaagaagtatcgaagatcggccggagacatatcggattctggatcttgggacgggggcaggttttccgggaattcctttaaagattgcttttccgaaacttcagattgtattggcagattcactgaataagagaatccgtttcttacaggaggtcattgatacactcggattggaagatgtgactgctgttcatggaagagcagaggagatgggcagaaatacattatatcgggaacagtttgacctatgcgtgtcccgtgccgtggcaaatttatcctctctcagcgagtattgtcttccgtttgtgaagatgggaggagcatttatttcctataaatcaggagaggtggatgaggaagccgcacaggcaaagagagccatttatcttttgggcggtgaagtgaaggatatttacaaatttgatctgtttgatcagaagcgttcgtttgttgtgattgagaaagagcggaagacgccgaaagcttatccaagaaaagccggcacaccgacaaaagaaccgctgcagtaacaaaaaagagagataatgcgatggatccttgatccggtcgtgtcatctctcttttgattttatgaagtatttgattgtataaggtatgacgttacattagtgatcttcatgtaaaaacatccgcatgatgttcagaagcttatccggtacttcaagctgcggggttagacctgcatttgaaatataggcggtttcgacagccgcgtttttgtgtgcataagaatctgcaatggcaactgcatctgtcatggaacggctttcaataatatacagtggaacggtaagctttttcacggcatgtccgattgcattgtcggtgtaatgtccctcgatgcttgccatcagatattttccgtggctctttcccatgtgcgatgcctcatagtaggcatcgagcattttactggatacgagctgcggtctgctgaagtatgttttctgcagtgtccgtcggatattggattcgtgtgtccggacattgtagaggaatgttcctatgatcggcagctccagcagtgtctttttgacagaggaatacttgtccggtgtgcggtcaaagctgctcatcgcaggcggattgatcgcagtgatgcttgcgagaagattcggattcatattctgggcaagtaccgcaaacgaaatagaattgcctgttgtcacgacatccgggcgttccccgatcacatcatgaataaaatctgtgagaagctgtacatacaggtaattggtataagtcagataaggcttgtccgagcggccgcatcccaacagatctatggtatatactgtatagtgcttctcaagctttttcacaagtctgcaccactcataagaagaagagatcggatttaattcgtgaatgagaaggagcggagaaccggaaccgcgcttggtataaaaaatactgccgttcttccagtgatagtagctgccgctttccgtctttaaaatatttttcatctctgctgtcatatcgatgaagcggttcacaagatgaatcgtgcctgcagcaagagcagtcagcagaaagaaatgtctgatattctttttcatgctattgttcatagaacctcccgtaatctttgcaaaacgtttcctattacttatattatagccgctttccataacttatacaaattaaaaattctgaaaatataaatttttgcttttcattgaattacgtttggtataaaataatactggtaatttggtttttaatatcaaacatatgttcggtggcaaaatggtagaagaatatattcagaaaatttatgaggaacttttaaaagaggagcagaacagtgcgaagcggatttctgatttacagattcatttgaaagagacgcaggcaatgatccatttgcttgaggagacgaatgatcctaattatgagtcgtttactccaagaaaagtaaattccaggaataagcagaaaatcgatgaattgcatgcagagatgaaagaactcgaggaagcaattcagcaggagacagactaccatacgcagcagatggaaagagtggaagaagcggcgaaggtattgcggcaggcggaagcagatgttgcatacaggtgtgacagaaatacacttgaggaagaaaggtatcatacgtctctccttgaaacgcaggagaatgagagacagcgtatttcacgcgaacttcatgacagtaccgttcagaatcttacggcaatggttcacatggcagaactgtgcagtaaactggtggatatggatccgatccggtgtaagctggaactcagtaagatgatcaagaatctcagggagatcatcgatgataccagaaagatgatttataacctgcgccctatgtcttttgatgatattggtctggatattacaatcgagagaactttggacaagctggaagcaaccggcacgaagaagattcattttgtagtggaaggaactccttatcaattaaaaccgattatcgggataacgttacttagaattattcaggaggcatgcagcaatgcgatctgtcatgcaaacccgactctgatacatgttctgttaagatatgagcaaggggctatcacggtaatagtcgaggatgatggaacaggatttgatgttcatattctggatgatcgtccaagggatgataattctgggtttggaatgtctatgatgaaagaacgagtatatttattatccggttcgatacagattgactctaagatcggtgttggaacaaaaattatagtgaaagtacctattagtaacaaggaggagttttaaatggcagtaaaagtaatgattacagatgatcattcattgattcgtgaaggattaaagcagctgttggaactggaaggagactttcaggtaattgcagaggcgtgtgatggtattgagtgcatggaaaaattaaaagatcagataccggatgttttgttgctggatatcaatatgccgcgcatgaatggacttgaagttttgcagaagattaaagatgaaaaaatagatgtcaagattcttgttcttaccgtacataatgaagtagagtatttattgaaagcagtggacatcggaatcaatggttatctgttgaaagactccgagtcttctgaattgaaaaaagcaatcttatctgttgttgatggagaagattacatacagccgagtctgattcctgtattgaatgcaaaaatgattgaccgggatatggacagtgagaagattgaaaaactgacgaagagagaactcgaagtgttgaaacttcttgcggttggaatgtacaataagggagtagctgatgaattgcacatcagtgaacgtactgtgaagaatcatgtatcaagtatttttaaaaagattgatgtttctgatcgtacgcaggcagcggtatttgctattcggaataatttgatttctattcattagtattagagagtataaagattgagtgtttcggaatcatccggtacactcaattattttatagaaaataatgtttattactacataaaaatattttaaaacgcgtattattggacaaatcatcacaatgtttcacgtgaaacattatataaatgaaatgtttcacacatgttttctacaagattttgtatttataaaaaaacagaaatacaacagtttgaaatcactgtgaaaatgtttcacgtgaaacatttcatacgaactttcctatagaaaagaatatgtaaaagtgttataatgaactctgtcgagttcatattagaagtttcaatgaaacttcggatgcgcaaaagaagcgcaaacagaagagataatgaactctggcaaacaaaacgcaccaaatgaacagggtaataaaaatttaaaagaggtaatatatgagcagaataattgcaatcgcaaaccaaaaaggtggtgttggtaagacaaccacagctatcaatttatcatcctgtcttgcagaagcaggaaagaaagtgttgaccattgatcttgacccgcagggaaatatgacaagcggattaggcgttgataaaaacgaactggaaaatactgtatatgaattgatgctggatgagtgttccatcaaagagagtatggcagataccgtagtagaaggaatgaagattatcccgtccaatgtgaatcttgccggagcagagatcgagttacttggtatcaatgaaaaggaatatattttaaaaaatgccgtagattatatcagggatgattatgattttatcatcattgactgtccgccatccttaaatatgctgacgatcaatgcgatgacaacagcggattctgtgctggttccgattcagtgtgagtattacgcacttgagggattgagccagctgatccacacgattgatctggtacagcagagactgaatccagatctcgtcatcgacggagttgtcttcacgatgtatgatgtgcgaaccaatctgtccaatcaggtagtagagaatgtaaaagaaaatcttgataccaagatctatgagacactgattccgagaaatatccgattagcagaggctccatctcacggacttccgatcaatatgtatgattcaaaatcagcgggaacagaaagttatcgtatgttggcaaaagaagtgatggagagataaggaggaaaactatggctgctgcaaaaaaaggtggactgggaaagggaattgattctttaattccaaacaaagtaagtgccacaaaaacggaagcaaagaatgaaaatgtgaaaaacgataaagtcatcgagggtgttctggtaaatatcaataaggtagaaccgaatcgggaacagccaagaaagaattttgatgaggatgccctgttggaattgtccgagtcaatcaaacagtttggtgtgttacagcctctgcttgtacaggacagaaaaggatattatgaaattattgccggcgagcgcagatggcgtgcagcaaagcttgccggattaaaagaggttccagtaattatcaagaatctttccaaccaggaagtcgtagaaatctccctgattgaaaatatccagagagaaaacttaaatccgattgaggaagcaattgcatacaagcggttactgacagagttcaatctgaaacaggatgaagttgccgagcgtgtatcgaagagcagaaccgctgtcaccaattccatgcgactgttaaaactcgacgagagagtacagcagatggtaattgatgacatgatctcgaccggacatgcgagagcacttctcggtattgacgatcaggaaaaacagtatacgacagcacagaagattttcgacgaaaaactgagtgtgcgtgagacggaaaaactggtaaagaagatccagcaggaaaaagatcagccggaagcaaaggaagaggtaaagatcgatccgaagatggaagcaatctgccgtgatctggaagagaagatgaaagtcattcttggaacaaaggttgccatcaatcagaaggataaccagaagggcaggatcgaaattgaatattattctatggatgaacttgaccgtatcatggatctgtttggatccatccgaaaatagacagagtaagattctgataaaagtcatatcagaataaagagagaggaagcatatgatttcacagtatttaggttttgattccgattatattattatcggacttagcgcagtggttctgattctattgattcttatcattgtaaatatagcgcagatgcggaagctgaaaaaagcatacaaagtatttatgagcggaaaaaacggtaagaatctggaagataccctgatcaagcgtctggatcaggtagatacacttcttgaggcaaacaatgagaatgaaaaaacaatcaaatcattgtttgaggccatgcagctgacctatcagaagatgggactgataaagtatgatgcgttcaacgagatgggaggaaaactcagtttttctcttgccatgctggatgtaaggaataacggatttatcatcaatgccatgcacacacgcgaaggctgctatacatatatcaaagagatcgtagatggtaattccattatcgtgttatcggatgaggagcagaaagctctcgacagagctatgggaaaaacagaaaacaacgaatgaggataatgtatgagaatacaactggtaagaacactgcaagggggggagaaacttgcagggccggtcataacgaaggaaaatgaaattctcatttctgagggaacaacgctgaaaacggaatatctggatctgatctcctttctgggaatcgagaccgtgtgtatcgaagatccctatgaggaagatgaaacaccacatgatattatcagtaacgaaaaacgggaagaatatattgaaaaaataaaatctattctggaaaagcatatttatcacaggggcagttctcttcgggaaattgaatacgtcgcagaggacattattcaggatgtcatgcaggcggatgaaaatatggtaattgatcttttggaacgcgaaagtaatttgtacgaacatacacttgtagtaacaaaattatgtattatagtcgcaaaaaaaatgaagctcactgcggagcagatttacagacttgcactgggagcattgctgcatgatctgggactccgctacattacggtgccgtatatcaactgcgacatcaacgaattgtcagaagcagaggcttttgaataccggaagcatccgatccttgcgtactctgttctggaggaagaaaaatggatggatccttttgtaaaaaaaatggtacttgtacatcatgagagaagagacggctccggatttcctctgaagcagaaaacgcgggatacggaatgtggaatattacaggcatgtgatgcatttgactgttttatcagcgggatggaatgcagacgtatgagcatccagcaggcactcgagtatctggtggaaggtacggatattttttatgacaggagaatcgtgcgtgtgatcgagcggctcgtcgcacgctatccggtcgggacgagagtccggctcaataccggagagtccggcatcgttttaaaacagacagaaaattccatccggcctgtaattagaattttggatgaagaggaccggttgacggaaaagatataccagttgaataagaacaagaatgtatctattcttcaggtcgaaaactagaaacagaaagaggtgaagatagaaaatgcacaaatttctaagagccatcgggttcagtcatattacaaaagaacagctgcagcatatttttgcagatattataagcgcaccgacggttcagaaggcagcacttgattcggagggcaatgaatttgcagaactgtcaaaggagtacggagattttttcggaatctctgtccggggcgtgtataacgaagatgatacctttgagatggaatattactatccgtatttgtgtggaaagaacatatccacaatagaacccgcagaagtggaaaaacatgcggaaaaagaatcctatgcggggatatgtgatgaagtccgcattggagtgacactcattttttatcttcagaatgtggtggattatcttgcggtcagcaagagcaaaggatatatgaatctggcagacggcgtcattttagctgcgctgtctacggagggaaagattttattcccgatcaataaggcggagaaaaaagtgcctcatgcgccaaaggagggaacagaccggaatcatctgattgccgcggcaagagacggggatgaggatgcgatcgagaatctgacgctggaggacattgatacctactcactgttgtcaaaaaggatcacacatgaagatgtgcttagcattgtggatacctactttatgccgtacggtattgagagtgatcagtattcggtgctcggcgagatcatggatgtgacactgctccagaaccgtttcacggaggaaaatgtatattccatggaaatcatgtgcaatgatattcttttcagcgtctgtatcaatcaaaaagatctgctcggcgaaccggaagtgggcagacgttttaagggaaatatctggatgcagggcagcgtaaaataccgggattagtttgtgattttcctatggtcttttgacggataatatgataaaatgaataagctgtatacagagaagcctgtatacagcaaatatatgtttccttagttaaatggatataacagccccctcctaaggggcaactaagtgcagaccatttagtgagacacaacgggattttagagtttgcaaaaaggctaaaatcaatatataatagcagggacaattcatcacgaaagtgattggattcataaacatggcagccggagccaaaaaggctgaaaagcccgaaaatacggcatttgttcccttagttaaatggatataacggggtcctcctaagactctattgtaggttcgattcctatagggaacgctctattttaagcggtaatgagagaaaaatcattgccgtttttttgttgtttttctgctaacagcaaatcaaaaaatgagcatttttgctaacagaaaatgcaaattgctaacagtaaaattattgtagatttgctaacaggaatgaaaagctataatgcaactggtgtaaaaggttgtaaattcttgtagctaacaaaagggtaatgattaaaactatttctgcttggaaaatatcaagcctgaatgagtattccgttcagattagattaggttctaatctgggcggatttttttatttcaggaagaaggaggatgcctatggcagaaaaagtggatcagatggatccagatgaaaaaatcgttgagatagcgattgaacggttaagagtattggcattgaaactgagaaattatatgaaaattgctcatccgggaactttcatttccaaaccagtaaactaagtaaaataaaaattctgctttacaaataacagataaagtattaaaataaacaaaaagatatcttcagggcagggtgagattccctaccggcggtaaagcccgcgagccgagaggcatgatccggtgagattccggggccgacagtacagtctggatggaagaagatgatagtacagttgattttttgtatgaatgaatgtagtatcagagctctgagatggtgatccatttcagagctttttatataggaaaatcagacattcatttatcaatcatatgtaacagatcaattccaccctgcagatatttctgcaggctttttttgtatctggtacatcgttttcgaaataactataccattcacttgtctgtgaatccgattgcacatgtttaaaagcctcggcgtagcccaggcaaagaacaggaataagaaagaaggaatagaaatgacggatcaggaatatatgcttcgggctattcaactggccaaaaaaggagaaggctggacgaatcccaatcctatggtaggggcagtgatcgtaaaagacggaaagatcatcggggaaggctatcataaaaagtatggagaacttcacgcggaacgtaatgcaattgcttctcttacagaatcagcagaaggtgcggtgatttatgtcacgttggagccttgctgtcatcatggtaaaacacctccatgtacggaagcgatcattgaacagaagatcagaaaagtggtgatcggttccagagatccgaatccgaaagtggcaggaaaaggtgtacagatgttaagggaagccggtgtaacagtagttgaagattttatgagagaagaatgtgatcagctgaacccggtgtttttccattatattactacgaagactccttatgtggtaatgaagtatgccatgacactggatgggaagatcgcaacgaaaacaggagcatcaaaatggatcaccggagaatctgcacgaaaagaagtacagcatatgcgacatcagtacatgggaatcatggctggtattggaactgtgcttgcagatgatccgatgttaaacgtccgggtagaaggctggaaaagtcctgtcaggattgtgtgtgacagtaagctcaggatcccgccgggcagtcagattgtaaaaagtgcggaaaagtaccggacgatcgtggcttatgcagaacagaaaaatgcagaagagaaaataaaaatattacataccatgggagttgaaaccatttactgtcccgacgaaaagaatcagatagaccttaagaagctgatggcagatcttggaaacagaggcattgacagcatcctcctggagggaggaggtacgttaaatgacagtgcactgcgagctggaattgtaaaggaagtacaggcttttgtggcaccaaagctgtttggcggtgtggctgggaagacaccggtagagggtattggagttgaactgccgtctgaagcagtggaactgaaatatacagatatctgccagatcggtgaggatatccggataaaatgtcaggtgtgtgataaaaaacaggaggaatcatgtttacaggaatcgtagaagagaaaggaaaagtccgttatatacagctgacaggggaatcagggatcctggcagtgaaagcccggaaagtcctggaagggacaaggatcggtgacagtatcgctgtgaatggtgtgtgtctgacagttacgtcgattcagccggacggatttactgccgatgtgatggcagagacgatcagaagaagcagtcttggcagctgcaaggccggaagccaggtaaacctggaacgtgcaatggctgcagacggcaggttcgggggacacatagtaagcggccatattgatgggactggcgtgatacgttccatgctccaggaagaaaatgccatctgggtatcaattgagacatcgccacagattttgcatctgatcgtggaaaaaggatccgtctgtattgatgggatcagcctgacagttgcaagggttgatgaagctggttttcaggtgtcggtcattccacatacaggagaagaaaccactcttttggaaaaggtgccgggggatctggttaatctggaaaatgatgtgatcggaaaatacgtagaaaaactgcttggcatcagaaaaaacgaagaagagaaaaaagaatccggaattacgatggagtttcttgaagaattcgggttttagaacaggaggatatacactatgtcacaaaattatcagtacaacacaattgaagaagcacttagggatcttaaggaaggaaaaatagttctggtcacagatgatccggacagagaaaatgagggagatctgatatgtgcggcagagtttgcgaccagggaaaatattaatttcatggcgacctatgcaaagggtcttatctgtacaccgatgagtgcagaaattgcggcgagattgaactttccgccgatggttgcggagaacacggacaatcacagtacagcatttaccgtggcagtagatcacgcagatacaaccacaggtatctctgcggaagagcgctcctatactatcatgaagtgtgtggatgatcagtcaaaaccggaggatttcagaagaccgggacatgtgtttccgcttatttccagaaaaggcggggttttggtacgaaatggccatacagaggcaacaacagatcttatgagacttgctggactgaaagaatgcggcgtgtgctgtgaagttatgaaagaagatggaactatgatgcgtacatcacagctatgggaaatggcaaaagagcataaccttacatttattacgatccgtgatctgcaggattatttaagaatacatgaaaagcatgtaaaggaggaagccgttgcaaacctcccaacgcagtacggtgattttaaaatgtatggttatatcaatgatattacaggagagcatcatctggcactggtaaaaggtgatctgggagatggtgaggatgtgctttgccgggtacattcggagtgtctgacaggggatgcattcggatcgctcagatgtgactgtggcctgcagctgcagacagcgatgcgccaggtagaagcagaaggccgaggaatcattctgtatatgagacaagaaggccgaggaatcggactgatcaataagatcaaagcatatgcgcttcaggagcagggatacgatactgtggaggctaatgtgaagttagggtttgcaccggatctcagagagtactgggtcggggcacagatactgtcagaccttggtgtgaaatcattaagattactgacaaataatccggataaagtctatggacttggcgaattcggactgaagatcaatgagagagtacctctggagattccggcacaaaagtatgaccggaagtatatgaagacgaagcaggaaaagatgggtcatatttttaaagaaataaatttataaaaaacagcaaatatcaggaggaagaaaaaatgagacagatcaatttagtagaaggaaaagtagtagcaccggagggaatgaaggttggtatcgtggcagcgagattcaatgaaattattgtgaataaattattgggaggggcagtcgacggactggtaagacatggagtagaagaagagaacattactgcagcatgggtaccgggagcatttgagattccgattacagcacagaagatggcacagtcaggaaaatatgatgcaattatctgcgttggagctgtcatccgtggagatacttcacattatgatctggtgtgtaatgaatctgccaagggaatcgcacaggttgaacttgcaacaggaatcccggttttattcggagtgatcacgactgaaaatatcgagcaggctattgcgcgtgcaggaagcaaagcgggaaataaaggctatgattgtgcattatctgcgattgagatggtcaatctgatgaagcagctctaaaagacaggaaaataaatgatgacaaaaacaatcatattcgattatgatggaacgatccatcatacccttggaatctatgaaccggcatttcgtgaaacctatcagtggctgacagaacagaaggttaccgaagaacgggagataggctcggtggaaattgccggctggctgggacttaacagtaaggagatgtggaatacatttttgccggaactggatcagagctataaagagcaggcaagcacgatggtaggagatctgatgataagacagatcaggaaacataaggcagtgtggtatccgggagcagaggagatgctaacagctttgaagaaccggggatatcaccttgtgatcttaagtaactgtaaagcttcatatcgtgaggcacactggaaggaatttgggatggaacgatggtttgaccgtttttatgactgtgaatcatacagattccgtccaaagacagaaattgtgcaggaaatcatccgggaatatagtggcccttatctggtagtcggagacaggagacaggatctggaatgtgccaggtcctgcaaaagcccttttataggatgcctgtatggatatggtgagaaaggggaactgaatggggctgattattatgcagaacatatagaggatatactgcagatggtgatatgatttttgcaatataaaaatctgaaggaaaaaagttaaaaataagtacttctgtaaaataaaaggatatagaaaatttgcaacaacttgttgcaaattctgaggaggggatgattttaggatagtcatagtgatagaggtaatccactttcctaaccccatctgtacagtaaagttctcaagtccagttgtacaaagcgctactgcacggggaaccagatggaatgcatctccacttcctaaaagaactgccataattccaaacatggtaaactgtcggtttcctttgcctttgcggatcatttatagattttattgtggaagattttgcataaagtgttttccgtgcttgtgtgtaccattatctgatatcaaagcagtacagggtgattccggccatgcacaggtcaatatggttacggatgcgtactctcatatttcggatgatgaccaaaggaaaaatgcagagctttttaaagaagcattttatgagaaaaagaatctgaatccagagaggcgggcgttgctcaattcgttggcgaaaacgatgaagtaatgaaaaatagtgaaaaaatagtgtaattttaatgaaaaaacaatccataaaacgatataatatatggatgaaatgaggatatttattgtgtatatggatattctatctccatcaaatctattgagatctccatcatttgatgatagaatgatggagataaatctgaaatgaaggagattcatatgagagactttgattttattgtaagtcctgcgaagttgttaacacctgaaattgttcagatggttagcagcatccatgaacataaaggcaaacaggaattatttctcgaagccaatgtagatgaattgaaaacacttttagaagttgcattgattcagagtacgggagcatccaaccgaatcgaaggtatatttacaagcgataagcgtttggaagaattggtaagtcaaaaagcagaaccccgcaaccgatctgagcaggaaattgctggttatcgtgaagtactttccacaattcacgaaggctatgaatatatcaacccaagaccgaacattattttgcagttacatcgagatctgtactcctattcacaggggggtgctggtggaagttataagaattccgataatgtaattgcagaaacagatgccgagggtcatcagaaggcacgttttattccagttcccgcatttcagactgctgaagcgatggaagaactttgcgcccgcttccttgaagcatgggaagctgaccgcattgataaactggttttgattcccatgttcattctggactttctgtgcatccatcctttcaatgacggaaatggtaggatgagccgtttgctcactttactgcttttttataaggcgggatacatcgttgggaaatatgtcagtatggaaatgctgattgaaaagacaaaagaaacatattatgaagcccttcaagcaagttctactggctggcatgagggagaaaacagctatgagccttttgttaaatattatctgggtatcatgttgaaagcatacaatgaattcgaaagccgtgtagagcatttgaagcatcggagtctttctaagcctgatagaattaaagcggttattgataacaaggttggcaaaattacaaagaaagaaatcatggagctttgtcctgatataagcaaaattaccgtggaaaggactttgacgaatctggttaagagtgggtatatcgcaaaagttggtgcaggtccatctactggttatgtccgtgtttaaaaatatgaaagcagcttataaatttgctagtcaaaaacgcatggacaaaccgtctcgtatgcgttatattatttatagacaagaaaatatcttgtacttacgataggaaagtttaattgaatactgtttaccatgatcgaacgtacgaagcatggtggtcatataacagatgtcgatggtaatatcaaggcattccccgattattagctggagcaaacaatcagctaactttcagagctttacagagcttgacagagggggtattcagaataactcaaattgaatcggaaacagttttatatagtgtcccacttgggtttaccttacctcagattgacagagagtgacaataggttggggtcctcctaagactctattgtaggttcgattcctatagggaacgctctattttaagcggtaatgaagatagtttcattgccgcttttttcgtgcagaattgcaatttcagtgacaggtttgtcagtgaaacagggttgaaaatactgattttgtcagcagggatggatgctgattatgtggacgatgacgaggactatgggtacgatccagaggttgaggactatgatgcagatagctccgtcgatgaagatgataatgaacctgtgtaaacaggataggcttaatgtctggggcaaccttcaggttgcctttacatagtctccactttcaaaaaataaaatattttgtgtttttgaaagcgatctcttgcatatactattagcagacagtataataagtacatcgaagcagtttcaagaaatgaaaaatttttgacttttgaaagcgggtgacgatatgaaaacaattacaagagcaaaatatctcgatagaatcattgaactgaatggtactcctgacatcaagatcatcacgggcattcgtcgatctggtaagtccaagctgatgcaggcgtatattgagtatctgaaaagccattttgaaaatatcaatatcatcttcattgacttcatggatttggcgtatgaagaaatcaaggaataccatgccttacacgcctatgtggaagaacattatcaggaaggtaaaacgaactacctgtttgtagacgaggttcagatgtgtcccaagtttgagttggcaatcaatagcctgtactctaaggaaaaatatgacatctatgtaacaggctccaatgctttcctgttgagtgcagatctggcaaccctgtttaccggacgctatattgaaattcatgtgtttcctttcagcttccaggaatattgccaatattataatgatgttaatgataaagataagctctttgatgattacgctatcaagggcggtttagcaggttcttacgcttacagaatcgaaaaagacagaacaaactatatcaaagaggtctacgaaacgattgttacaagggatttggtgcagaaatatgcgctcccggacactttggttttacaacgtctgagcgagttccttatggataatatcagcaacctgacttctccgaataaggtcagtcagctgctgacagcaaatgagaccccaaccaatcatgtaaccgttggtaagtacattaagcatttgtgcaatgcttttgtattttatgatattaagagatacgacatccgaggtaagaaatatcttgaaagctctgaaaagttctatttgtgtgacagcggtattcgatatgcaatactgggaagcagaaatatggattatggcagagtatatgaaaacatcgtttgcatcgaacttcttcgccgtggatacgatgtctatgtcggcaagctctatcaaaaggagatcgactttgttgctcagagaggcagcgagaagatttatattcaggtcagcgacaacatttccgggcaggaaacatttgagagagaatgctctcctctgcttcagattcgggatgcttatccgaaaatgattattgccagaaccagacatccccaatatagctatgaaggagtcgaaattcacgatatagccgattggctgctacaagaataagcagggcgaaatatctccgtctacagagtaaaatagatagttactttttctgcagcctgtgataaacttgttcatgagcgggagaaagattttggactgcacccccaatatcgtcataaaagcaggggaaatgccccggaattatttaataataggtaataaaaatgacagaagagaaatatacgatccataagtataaaagaattttattttatgtggtgatacttgtgctgtttgcagcattttttttagggcaaagcatttaccccagtgagagggaaacggtcacggaggaaagcattacttataccggaaccttttaccgggagctgccagacggaacagaagaggagatccgggttccggaccggtatgatgtgcctgccggtgagcttttagtcatccggtcagtgctcccacaggactataatgaaaatacgatcgccatcagatcctctctggagaatgtgcgcgtttatatcggaggggaactgaggacggtgtatgatacgaagaataccagacccttcgggaaaaattctgccagcgggtatgtgttctgcgagacgtccggtgaggatgcggggcaggaagtgcggattgaactgcagtcttttactgaaaagtattccggtgtcgtcaacacggtatattgcggggataaattagatatctggggctatatatttcactgctattttatggtaactctgatcgcctgcactatgctgttttccggactggtcgtgctgatcatcagtctggtgctcgatattgtatacaagacaagatttgatctggaatatctgggatggtgcatgatcctgggagcagtgtggatgctgggagaatcgaagctgcgtcagctgtttgttcccaatgcttctattctgtcgaatatgtgcttctttgttgtgatgatctgcccggtcccaatcatgttctatattgatagtgtgcagcagggaagataccggaaggtctatcatgtggcagaatgtatcatttgtgtgaattttgtgatatgcacggtcttacaggtactgaatatcgcagattttatttcgacaatgttcttgtcccacatagtgatcgcaggaacgttcctgacgatatttatcaccatctgccgagatcttatcaagggaacagcgaaacattacaagcttccgctgattggactggtagctgccatgatcgcagtcatgctggaggtgacagaggtgtatcgtgttgtgtctatgtccggaatctttatcgcaatcggactggtggtcctgctggtcgttaccctgatccagacaatggaccgcatccgcgagctggagctggcacgacagaaagaggcccgggaaagcctggattacctgacaggacttcccatgcgtcataaaggtgagacactgattattgaaaaaatgcaggagcatgatggctgtctgggatttgtggatatggataatctcaagaagatcaatgatgtctatggacataaggcaggggatcatgctctcaggctggtaggagcaatgctcacagcgtgcatggagaatgcggtggtctgccggctgggaggagatgagtttctcttctatctgtctgaggtatcagaagttgagatgaacacgcagatgagaaagctgtttgacagctttgaagcggcaaaaaatgccacgacggagacttcaccggcattcttatcctgcggtctgtgcatgtgcagacagggagaaagctttgaagaatactatataagagcggacaaggcattgtattatgtcaaacagaacggcaagaacaattaccggttttatgaggagctggcggaacagtaagcatcgatattccatgccattttagaatacctgatgccggccgatgtattgacgctggaataaatcgtggcagaaatcccagataaaagcaggaatttaggagaaataagataatgtcaaaagatgaatacctgatcacagatgccccgctcaaagcgttgactgtttttgcaatgcctatgattctgggcagctttttccaacaggtttataatatggcggattccattattgtcggccagtatgttggttcgtctgcacttgcggctgtcggtgcatgcgcggcacttacgaatgtgtttatttgtgtggcacttggtgccggtgtcggtgcaggcgtactggtgagccgctattttggtgccagagattacggcaaaatgaaaacgattgtgtcgacatctttgatcagctttctgatcctaagcatacttcttggtgtattcggctttcgtttttcccatccgatgatgagccttttacaaacgcccactgacatactggaggaagctgtactgtatctgcgggtatattttgtgggatttccgtttttatttatgtacaatatcctttcgacgatgttcacctcaatcggggaatcaaagattccgttgggtctgctgatattttcttctgttttgaatattattatggatctttggatggtggcaggacttggattgggtgtatttggtgcagcccttgcaactttgatcgcacagggcatttctgcggtattttcattcgtgatctttttttaccggatgcgccaatataagagtccatttcactggtttgacggacaggagttacattatatgctccggattgccataccgtcagttctccagcagtccacagtatcaataggcatgatgatcgtgcaggcagttgtaaacccatttggtacacaggcactcgcaggttattcggcaacaatgagagtagagaatgttttctcactgatatttgtgtccattggcaatgcagtttcgccgtatgtgtcccagaatcttggtgctcagaaaatcgggcgtattaaaaaaggttatcacgctgcactggtgttagatctgtgctttgcagttctggcttttataattattgaaacactgcacacccagatttcttccttatttctgggaaaagacggaactgctttcgcatatcaggtatccggggattacatgagatggcttggctatttctttattttcatgggtattaaaatggcaacggatggagttttgcgtggacttggaatcatgcgtccatttcttatagctaatatggtaaaccttgcgatccgtctgtcggttgctttgatttttgcaccgcgctttggtattgcatttgtctggcttgccgtaccggcgggctggttggcaaacttcctgatttcctatgcggcgcttagaaaatcgtggccggatgatagaatcgctgcatcctgcaacggttgtatggattctgcagaaacgaagaagtagctgcagctgccaatggaactgcacggattgactgcaacaaaaacttccagagaggcgaggaggaagcaggagctgctgcggttgaatccatatcggaaaatatctatagtcgaaaagcaaaaaggcggaagtctctgtgggaggcttccacctttttatctacagcaagaagaatgagttttctaatcgatctttaaaatcagatcaagtacgcgcttggcacagcgctccagatcgcttcgatcgagagcaccgagttccatcgcctttttcacgcgttccgggaaaccgcacgccattttcacatcatttccggctttgatctctttgtaatgttctcctctcgtccaccagtcggaggttaccattccgtgaaaatgccactcgtcacgcaggatgccttcgagcagatcgtgattttccgaagcgcggtggccgttgatcatattgtaagcggacatgatgacccacggatcggcttccttcacgatgatttcaaatgcctttaagtagatctcgcggagtgcgcgctcggagacgcgggagtcgctgtgcttgcggttggtctccttgttgttgcatgcaaaatgcttcacggctgcgccgatgtgctgcgactgaatgccgcgcaccatggctgcgcccattttgccggtgagcagcggatcttccgaatagtattcaaaatttcttccgcagagaggattgcggtgaatgttgaccgccggtgtcagccatacggcgatgttgttctcttttacttcctctgcgcctgcggttccgacctgctcaaccagggcaggattccaggtggaggcgagcagtgtggcgcatggccatgccgttgtgcagacctcacactgcggggtgatgcgcagaccggcaggaccgtcggcggtcatgatgtttggaacgccgtattccggaagattgccgtagccgtaggtattcgcgacagaggtattcggctgaccgccgagcagatgaattaggtcatcattatcgagctgggcggtaaattcatccagggaaatctttccctcgtaaacgtcgatcagcggatgcgcgttttccttatagaaattcagcagaaggtaggagccgcgtccgcgtgttgccggggcgagagcctcctcggtgcccggtaccattttttcaaaaacacaggcattcggatcgttggcagttccctgcggaagctcttcgtagcttccgtctgcgagcagacgcttcttcaagcttgtaggtgcggctttggaggaaagctgttctaccagcaggttggcgttaagcgtcatgacataatccagcgcaatgacatcccggacggaagttccgatgtaaaaatgatagtctcccttttccagtatgtaggaggatttgaaaatttttcccagatcatcgtaggaagccatggaatcctttgctgtctcgagcgtcagaagctggctttcgcccgggaggagcgttcttgtcttgcaaaaagcggagagttcgcgcgccggtttctgcaaaagtccctgcggcgcactgtaatacatctgcacgacttcttttccgctgtaatctccggtatttgtgacaaggacaaaagcgcgaatggcctgctcggtttcggtcacactctgcaccacaagggagaactgtgtgtaggaaagtccgaatccgaacgggtagcatacgcgttttgccgcatccccaaaagtctcaaaatagcggtaacccacatagatatcctcggtatagtccacgtagtcaaccgattcgtggaaattcgcggtggaaggatagtcgttcacggaagcggcgaaggtgtccggaagcttgccggacggggatacctttccacacagcagttccgccatggcaagtccgccctccatgccgccctgccatgcgatgagcgcggaggagatctgatcgtcatttttgatccaggaggtatcgatgatgccgccgatattcaggacgactgcaattctggaaaaatgctgctttacctgcgcgatcatggcggattcttcctttgtgagatagaagtcgccgtccgggaagatctctccggagattttcggcatgctggtctctgtctcccacggattgtattccccgttgtattcgatgctggagcggtcccagccttctccggaaaaacggctcaatacgatcacagccgtgtcggtataggcgctggcgccggcgagaagctcggcggagagcgccggctctgtcgtcatgccgggaacggaaccctgatcgtactgttcgttcacattggcgcggtagaaatcgcacagcggctcgtagagggagacggcatcgtggagcatctgaaagccatcgtagagattgtgcacatacgatacggtcacatcgccgctgccgccgcctcccttgacataatcaaaactgccttttccaaagagtgcaatccggctgcctgcttttaacggcagcagattgtgctcgttctttaagagaaccataccctctgctgcagcttccctggaaagtgcgatgtgttctttggaagcagtcacgtaacagccctcttttaatggacggtttggctgatacatcactctggtccatttcttcattttgacctcttttccggcatacgcctgatattattttgatatttttcagtatggaacattgtctatgctcgtattataagcagataattccgtttgttatagatcgaattttggcagaaatataggtcgatattgatattttttccttctgaaggtatgatgggagaaagagaagcccgtgcatgtgaaaacacggagagagcaggaaagagagggagcgggagtgcagcagggggaacatgagattatatccgatgacgggctgatgcagctttattttacacaggtcgacgcgtccaatgaattgctgccggcacactggcatgagcatctggaaatgatctgtatgcagcacggggcaatgacagcgtacatcaatgagacgtcgtatgaactgcagcagggagatattctcgttgtcaatccgagagacattcactacacgcatgtccacggggacgggcattactatctgctgcagattccgccggagcatttaaagcgcgtcagtgaggactggcggggactgcatttcggggaatatgttccgtattcggaggagaccgcatccgtgaattgccggatgtcacagaagctggaagaaatgaagtgcctgcaggagcaggcggcggacggtacgcatctgctatttcttgcagcggtttataagctgctgtatctgctgtatacaaaggatgcggccacggtcgatcatgtgctgcgccaccgctccaggagagattttgagcggatcgagcagagcatgcagtatgtgaaaagaaattacacgaacccgattactttaaaagagacggcagatgaactgtcacttacgccggaatatttttgccgtctgtttaaaaagtacaccggccagacatttttgacttatgtaaatcaaatccgcctgcagtattttcacagtgatctgctgcagacggacgagagtattacttatttaatgaataaaaatggaattaccaactataaggtgtttctgcgcagctttaaggaagcctacggcatgccgcccggtcagcttcgcaaaaagcagagagaagtaagagatgccggagcaatcagtgcgcggtcagcttcttcatccggaaatgatagtaaaacagaaacagaacggacgtcaaaacccaggacaccggataattgaggagcgttacggtgagcgtcgggaagagggcgaccactccgaaaatccataccacacggaacaggcagataccgccggttgtgatgagcatcggaacgacgacgtcgcccatgccgcgcagcgcaccggagaagacctcggtaaagacgaacagccagtaaaacggagccatggtcgccatcattttcagtccgatctccacgacattttcatcggtcacaaaaatgtggaagagcggaatgcggaagcatacgagcaccagcatcagaaggatggcggcagcaaagtccatgccgatgcacacgcggatactttttctgacgcggtcatacttcccggcgccgtagttctgaccgacgaaagttgtgatggcaataccgaaagcaccgctgaccatccagacgatcgcgtccagttttccgtaagccgcccatgcggcaaccgtgtcggttccgaatttgttgagcgcggactggataatcatgttggaaatgctgtacatggcatactgaaatccacccggcagtcccaaaagcagctctgatttgagaagtctcgggtggatacggatgtcttttaaggaaaaatcgcagagatctttctggcgcatcagaaaaacggtaacgattacggcgctgatcccctgcgagagaagcgtggcgatcgccgcaccggcaacaccgagtcccagcccgacgatcaggagcaggtcgagaacaatattgatgacgcagcagatcatcagacagtacagcggacgtctggaatctcccagcgcgcgcagcagtccggctccggtattgtaaataaacacgaagaaaatgccggcaaaatagatgcgcaggtagaggatggagtcactcatcagttcttccggcgtattcatcagtcgaagaagcgccggggcagcagtgatgccgatcagtgtcatgatgacgctgccgatgatggagaaggcatagatcgtatgaatactgtcgtccacctttttgcggtccccggatccgaagaactgggagacgatgacggaagcaccggcagtcagcccggtaaaaaagttgaccagcaggttgatgaccattccggaggaaccggcgaccgcggcaagtgcatttttcccgacaaagcgtcccacaatgacggcgtcgatcgtgttgtaaagctgttgaaaaaaagaacccagtaaaataggaaagaaaaataaaagaagctgtttccagatgataccggatgtgatttcgttcttggaagaggtttcgttcatgctataatctccatatctgtcgtaaaggtataaaaaatgtgaaaataagtccgaaatatattataaaatctgtagcataaaataacaagaaattccgtttatgttttttgcgttctgtgataatataacactatacaatgcctgttgccagggatggacaggaaagccacggaggacacactatggataagaaagagaatcagccacgcgagaaaaagggtatgccgcttgcaccggtctttttgctgggagcaacggtgctgctgttgattgaaatgtattttatcgtcaacctgccccgggtatatctggtgcagattattctgggagcagcaattctcgcctgtacttatgtatttattgctgccttattaaaggagatacataagagcggagagcaggcaaaagacgaatatgagaggatgcttcgcggagaaaaggcgtcgtatctgatgctgaagaaaatctcggagcagctggaggcggttgaccgcaataccagggagccgggcgaggagattatcacagcgcagaaggcgatcgccaaggtgaccattaccagaagcaaggaaaatgcagatgcacttatgaattccaacgaccgcgtagtggacaatctcttacagttaaaggagagcatggatgctggattcgagcagtttgccggaaagcagcagaacatgatggatgattccgttaaggaactcgtcttaaagcagcaggaatttgccgaggaattaaaggaggttaccgcagggcttaaggagattaccgagggacttcaggcagtgaaggagacggttgcagaggaaaaggcgcagacgcttgccgctattgagagccggatggacgaactggtaagccagaatgcggcgctggagagtaaaattgcagaaagcacggcagctgcagcagcgcagaagccggagccagacatggagccggagctgacagaatcagagccggttatgaaagcggagccggagctggtcatggaaccacagccggaagaggtcatggagccgcagccggaagcggtcatggagccggaagcggattttagcatgccggatacaccggaggaggaactgccggttgtagatgcagagacggtgacggatgacaccccggtgatggaagagtatgaggaaccgatcgtagattccgacgcgattgtggaagaggaagatgcggcagctgccacagacgatcagaatgaggctgaggcagagagtgcggcgatagacagtttcgattttggagcagatgatctcgatttcggaggagacagcttagaccttggagtggacggtcttgatctcgggacagagaaccttgacctaggagcagataacttagatgccggagcaggcggacttgatcttggggcagacagcttagacctcggaggagacagccttgatttaggagcagatagtctcgatcttggagcagagaaccttgaccttggaacagagaaccttgatctcggagtggatagcttagatttaggagcagatagtctcgatcttggagcagagaaccttgaccttggaacggagaaccttgatctcggagtggatagcttagatttaggagcagatggctccgatctcggaggagaaagtctcgatcttggagcagatctgaaagaggaagccgcaccggagaatgaagcatcggacgagccagagccagtagccgcgccggagaacgaaataccggacgagccgaaggtggccaagccgcagaaagagcctgagacaaaggcagaggaagctgcaccgatggatttttccgatccacacaagcttatgactccggaagaaattgccgcattgattgcaaaaatgtaagagcaggttccgggataagcaatgaagttattagcagtttcagaataaaaaatgagcgtggaagattctctgaagtaaaatgtgggaatttcttccacgctatttttgtatctgaaacgataatacttatttatatatcccggaacttcctattacgggaatctatgcggcaattctttccgtaatcttacagatcagactccgcgacgatcgtcacgatattcttgatgacggagactgctgtctgcatgccctccacgctgatatgctcatacggaccgtggaagccgtagccgccggtgccaagattcgggcatggaagccccataaagcttaatctggcgccgtctgtaccgccgcggaccgggcgggagagcggtgtgagaccggtcatcgagattgccttttttgcgatatccacaacataaggatgctgttcgatgatctcaagcatattggagtaggaatccgtgatggtaagagagacggttccggtgccgtatttctggttgatctccacttccagtgtgcggagtctgttcaggcgtgattcaaaagaagccctgtcgtggtcacgcacgatataggaaagttctgcaaaagcgacatcacccttcatgtcggtcagatgatagaagccctgtctgccctcggtgtgcgctggtgtctcctccggcggaagctgcgactggatatcgcacgccacaagagcggcatttaccataatatcctttgcctcgcccggatgcacattgacgcctttaatggaaaattttgcgctcgcggcgttgaaattctcataggcgacttcgccctcgtaatcgccgtctaccgtgtaggcaaaagcagccttaaaataatctaggtcaaataaatctgcaccgcagccgatttcttcgtccggggtaaatcccacccagatatctccgtgaggcattccggaagaaatgatctcttcgagcgctgtgatgatttctgccacaccggccttgtcatccgcgccgagcagtgtcgtgccgtcggtggtaatcagggttcttcccttcaaatccttcagcgttggaaaatcagaaacctttaacattgccccagtaccgtttaaacggatgtcaccgccgtcataatccggaatgatctgtggtttgacgtccttgccggagtagtccggtgcggtatccatatgtgagataaaaccgacggccttgcgtccctcacagcctgcagtcgccggaagcagaccgtacacatagcagtggtcggtcagaaccacatttttaaggccgagatcccgtaattcctgctctagtacctttccgagatcaaactgacgcccggtagacggaatttgtaccttgccgtctgtcatgttattctcatccgatgtcgtccaataggacacatatttcaataatcgctgttcaacttgcataagaaacctccttgatctatgccattctatctataaaataacacaattgaaaaaaaaattgaagttttttaaaaaaaatgttgcatttctaaaatttctgttatataataattttcgtgctcgggtgatacagaacacgagatacaaaataagcgccactagctcagctggcagagcacctgactcttaatcagggtgtccagggttcgaacccctggtggcgcattgaaaggtaccgattttacagcattgactgtggggttggtgctttttttgtatttataatacatatcattaaaattttttaaaaaaagagtgtatcctatttaacagaaggaaaagcctgacgatataaaaaacagatactatatgaaggggagagaggcagatggaacaaaagaatattgaggtgcaaaggaaaaaaggtctgaatctgatgatgaagattctgatcacggcaatcataccgctactgattcttgtgacttttgcagggctggcaatccgggcggttggcgtttctgtgtctgataaactgatgcagcatgaattgaagacatcgatttatgcagtcaatcagaccttgtccgttataagcagcggcgactggaatgtggacggagaccagctgtacaagggagattacaatatctcggaacatcaggatgtgctggatgcttttaaggagaataccggactcgatgttacgctcagctggaatacgacccggatggcgactagccttgtgagacaggacggcagccgtgagaccgggacggagatagcagcagatgtgtatcagactgtgaaagaaaagggtagttattttgtgtccgataatgtgattgatggtcagaaatattacggatattatgagggattgtacaacagtgacggttccatggcgggtctggtgtttaccggtatggcgtctacttccgttcacgaaatctacaatgaccgattgaaaaaaaatataatatttatggtagtgcttgcaatctttgcatgtatctttctggcaattgtgatgatgaagattgtgaaggcaatgatgtcgatgatcgatcatctggacgatgttgcggagggaaatctggacagcaggatcagcgaccgcatgacgagccgctcggacgagatcggaaatattgcgcgtgcgctgtattcacttattggcggactggccatgattgtaaaaaacatccggacatccgcaaagtcgctggatgatttcagcgccaggttccagaacagctttacgacgatcaatgagtccattcataatgtgaatacagcgatggaggacattgcgaacggagcgacgaatcaggcgggcgagatgcagaaggtcaatgagcagatcagcgacatgaacgaagccattgccgagacgacaaagaacgtggaaaatctcacgggcagcacggaggagatgaaagagcagaatcataagctcgacggcacgatcaaagatctggtggagatcagcgaccgcaccagagaatcggtggatgaggtcaaccgtcagacagacaggacgaaccagtctgtcatggagatcggcagcgcgatccagatgatcacagatattgcaagccagaccaatctgttgtccctgaatgcgagcatcgaggctgcgcgtgcgggagagcatggaaaaggatttgctgtggtggcggatgagatccgtcagcttgcggatcagtccagtgactccgcgaagaagatcggtgatattgtggaagaactgattaagaactctaacaagagcgtcgagacgatgaacggtgtgctggatgagatcaatgagcagaacgagaagctttcgaccaccagagaggcattcgacggactgaatacggaggtcggcaatgtggtagttgcgattgacaatatccggcgtgagatcgagacagtcaacacggcgaagaatgatgttatgagcagcatggagagcctggcagcgattgcacaggagaatgcggcaagtaccgaggagacgtcggcttccatgacggagttaagcggcatcgtcacggactgcaatgcgcagacgaaaaacctcgtggatattgcagaaaatttaagcgacaatgtcaaccagttccggatcaaagaataaaagaaaatagaacacaaaaaacacccgcaggcggatcgagaaaaatccagactgcgggtgttttttatctggaagcgatcagcttgcagatcggattgccgagggaggagaacttctcctcgtactccgtcatgatattgccttcattgagcaccggatcgtgatgcagatctctggtggaggcgtccagatgccagccggcttccgggatctcctccagggaaaaggtaaaaagatcctgattgtcggtcttgaactccagatgtccctccggcgcgagaacctcatcgtagcgcgcgaagaactgacgggaggtgagacggcgcttggcgtgtctgtccttcggccacggatcggaaaagtttaagtagatccggtctacctctccgtgatcgaatacctcagcgacatcggcggcgtccatgcagatgaaaaacaggttcgggagcggattctcttccattttctgcagggcgcgcagcaggacgctggagtagcgctcgattcccagataattgatgtcgggatgcgctgcggcaagatccatcatgaagcggccctttcccataccgatctcaatgtgaagcggctgctgtgacggaaaaatctcctgccaatggcctttgtgcgtctcggggcttttgatgcagtagacgctctctgtgatggcggcgtctgcacctggtatatttctaagtctcatattgttcctgcctctcataagaaaatcttaataaatgtcgggaagtcctataattgtggacatacaagatattctacaataaatctgtggataaaaaaagagcttttgccagaaaaattgttgcatgtatttttttctgcgattatactgatactagttatgttccggatatatatggaagaaatggacaggatttctggatagaatggagttataagcaatgcgaagagcgaatgtgtggaaaaaggcggcatgtgtcgccttaagtttactatactttttacagataaagccgcaggtggtgcaggcggcagattactggccggaaggaccggaagtacagtcaccgtccgtgatactgatggagatgtcgacggggacggttctgtacgaaaaaaacagcgatgagcggaattatccggcaagtatcacgaaaatcatgacgacgcttctcgcgctggagaattccgatctgaatgaggtcgtcacattttctgatgatgcgatcaacaatactgaggggtccggaatctaccgcgattacggggagcagatgacgatggagcaatgcctgtacgcggttatgctgaattcggcaaatgaatgtgcctacgcagtggcggagcatgtcggcggtacggtggagcattttgtggacatgatgaacgaaaaagcggcggagctgggatgtaccaacacgcattttgccaatccgcacggtctgtttgacgagaaccattacacgacggcgcacgatatggcgctgattgccaaagcggcataccagaacgagaccttccggattattacggggacggcacgctacaccattccgccgacgaacaagcatgatgagccgacggatctgcagaatcacaatgagatgctctacccgttcaagacgctcaagtaccggtatgagtattgtaccggaggaaagacgggatatacggatatcgcgcgtagcacgctggtcacttacgccgagaaggacggcatgagtctggtatgcgtcgtgatgcatacggaatcgccgaatcagtggaccgacagccggaaccttttcgactatgcatttgataatttccagttgttcaatattgcggacaatgagaccagatacatggattccgaggcggtggaagttggagccttaaataacaacaaggcgtttgtggacatcgacgcgaatgccaatatcgttcttccgaagacgaccgactttaacgatgcggcatcggagatcacgtatgacgacgtcagcgagaacgtggtgggaacgcttgcctacacctatgcgggacgtcaggtcggaaaagcagacatagtgacaaccggtgcggttgtggacggatatatttttgacaaccagagcgaggtagagcaggagacagacaccgaggaggagacggtctctacggtgcggatcagaccgcgcacaattttgcttatcgtagccggaatcctgcttgcagtagggttgatctttgccggaaagaagttctacgataactattatattatccggcacaaccgggaagtgcgcaggaaccgcaaagagcagtttcgacagataaaaagcaagtcaagacgccgtagaagacatagaagatagtatagagaaacaaaaaacgacaatattccatgttgaatattgtcgttttttgcgttatggacacgaaaaaaatgataataaattatctgacaattaagcttttcagcaggatttcaagttgattcgggttctttgtgtaaaaaagaatgccgcctgacacagtgtgcgcggtcagatattttccctgaaacagaggggagtccgtgatgcgggaaagcatgtaggaggagacagcatcgtccgcttttaaaaacagaggctggtaatcatccatccggcagacgtcggcatttgcttttttgaaaatataggtaagctcctgctcctgcgctaactgttcggcagtcttgttcggaatgaaatagccgagttcatccttcggcatattcagagagcggatggcgcgctgcacctgtttggtcagagcgtcggacgccgggtatagagactcaaaatatttcatgaaatcggcagccgtgcggaaatgctcgttttttcccttttctaagacctcggtcatcaggatccggcggatgattccctcgcaggtttcccgggacggattcttgcgcagggagggtgattttgcttccatagagaactcctttctgcaaacgacaaaaaaattgtcttttatgacattataagacaaatcaagagctgtgaacagccggaaaaacgacagaaacgataaattgacaaacagcagagtatcctttatagtaaaaataagcaataaataccacaaacatatacattgagcggagaagttatacagaactttccctaaaatgcgtagcaggaggggaaggctcaaaaggaaaggtacggggaacgatatgtcagaatcttatgtgattaacgaaaagagggaactcattctggatcgtgtcaaagagttcatctatcagaatggcggtgtggtgaaaaagagccagctgaatgaactggggatcgattaccggcggattctggattttgtggaaaagggagatctgatccggatcaagaacgggtactatgcggtgcggctgagtgatttctcggaggaggagctgattgcgcggctgtttcctgattgcgtcttaaatctggagaccgcattgtacgcgtacggctatctggaccgcaagccttacggatacaaattgtcggtggacaagaacacatccaagtcgcggtttaagctggattttccgccggtggtgccgctgtatgcggagccggagaccctgacactcggtgtgacggagattgactatggcggcgcgaagatgaaaatttttgaccgggagcgcctgatgtgcgagtgtctgaaatatgaagataagatggagcgcgagcttttcaaagaagggcttttagcgtacatccgtgatccgaagaaggatgttgcaaagttgatgaaatacgcaagggaacgcagagtggtaaagaaagtacagacgatgataggagtatggctgtagatgaaacatacgatcatagaaaaagctgcactgaaagcaaaaagtgaagagaccggtattccgttttccaatctgctggcaggctatgtactggaagagctgatgtatctgatcgaggattcgccgttttccctgtttctgtggctgaaaaacagcggtgcgctcggggtggaacagtaccagaagaaaaatctgttgacgctggattttgcctatgtgacagatccacgcgctatgaagcgggaggggatcgttccggggcaggaactgtctcttaagatgggatatgtcatgctcgcgtacatcctaaaagtggaaaaggtgccggacatttcctggaaaggaagagcgagcgcgggagatcaccgtgtggatctggagattgcgggggagttcgaggagatgacggtcccgatccatatccgcgtcacggaactgaccgaggaaggcctggttccggtcaagcggacttttatgccgtttatggaaggcggaaagcagattccgtatctggaatatccggtggagagtattctcgcggagaatcttttttatctgatccgggatatggaactgcttccggatatgagcgtctacgataaggtttacgggatattaaagacggagccagtggacggcaggcatattcaggaactgctcggcgaacattgcaaaaagcagcagttacttcccgaggagtcgcggatgaaagagattctttcctaccgcgattacagctacatgagaaagcgttgggagaaatatttaagacaccggaaaagaaaagaacccgcatggacagaggtcatgcaggttctggaacaattccttccgcagatgtggagcaccctgtgccgggacgaaatttttttcggagactggatgccggatctgcagcggttcttagattagttaaatgcagtgaaggtgtcggagcgccagatagtagtcgtccctggtatccagatgggaaaattgaagatctgccggaatatcggagtctttggttgcttcttcgcgcttcagataggacacgctgcatttctcgcgcagcgtatcgaaagtgaactggtgcaaaagcagacactttccgatggatggcaggcagcttttggagtaggcggacgccggtactttttgatccgtttcggtgccggataccgcggcgatgtcaaaaccgtccagatgctccagcagctgcagtccgacttctggttccagaaaaggggtgtcgatcggcagaataaacgcctggtcttcatccatcatggagagaccggaaaatacgccggacatcgggccggcgttcatgtacagatcggcaatttctgtgacggggagtgacaggtgtgtatattcgcccggctttttcacggataagtaaatatgcgaaaaatgcggtttgtacttgttcacaaggtattccagcagacttacttcgccaaaaggcagcagggctttatcggttcccatgcgcgtgcttccgccgccgcacaggataatgagtgcgtggttcataaaaatttccgccatttctattaaataaatatatcccatatcataatggaaaacggtggaatgttcaagtgacaaaaattctgctgcgcggatcgacgggacaaaacaagatggattgacaggggaaagtgacaggaataatggagagagagcatttgtatcaacagctaatttcatacggggaatcggatgtctacccttttcatatgccggggcacaagcgccgggcactttcgtttccaaatccgtataccatcgatattacggagattgacggatttgacaacctgcatcatgccgaagggcttatcagggaggccgaggagcgcgcggcgaagctctacggtgcggaccggtcgtattacctggtaaacgggagcacctgcggactgcttgccgccatctgcgctgccgcacggcggggagataaggtactggcggcaaggaactgccacaaagcggtctatcacgcgatttccatgcagggactcgcggcggagttcctctatccggcaatcacgcggggagatctgcagggacagattaccgcggcgcaggtggaggaggcgctgacaaagcatccggatattgcggttgtgatcctgacatccccgacctacgaggggatcgtgtcggacgtcgcggcgattgcggcatgctgtcatgcacacggggcggcgctgattgtcgatgaagcgcatggggcccacttcggattcggagccggattcccggaaaatgcggtgcgccttggggcggacgccgtgattatgagtctgcacaagacgctgccgtcgtttacacagacggcgcttttgcattgtaacggcacgcggattgatcccgggcgcgtggcacggtatctgggcgtctatgagacgagttcgccgtcgtatctgtttatggcgggaatggatgcatgcatcgacctgatccgtgagcagggggcagaactttttgcggaataccggagacgtctggatgcattttaccgtgatacggcggaccttacgcagctgcatgtcatgcggcgggaagacctctgcaaggaagaagcgtatgactgggacgattccaagctgattatctatgcgggcaccatgggcggcgaggcgctgcatcaggaactgctcggacattatcatcttcagatggagatggtgtcggcggactatgtgctcggcatgacaagccttatggatacggacgagggcatgcggcggcttgtgacggcgctccatgagattgatgaaaagaaccggcgtatggcggagccccacgagaccgctgaagagaaccggaagacggaattagacggagaagtgccggaagccggatttacggcgcgcatgtaccggaagaatccgcgccggatgcagatttatcaggcgctggatctgccgtaccgggaggtgccgcttgatgaggcagtcgggaaaatggcggcggattacgtttacctgtatccgcccggaatcccgctcatcgtgccgggagaagttatcacggaagagtttatccggcacatcagagagtgccgggagagaaagctgaacgtggaagggcagggaaatcttgcccccggtcggataaagattgtatatttttaaagactatattatactagaaggtgcagcgaatgggaaaaatctattgcatgatgggcaagagttcaacaggaaaagatacattatataagatgcttctggaagacggggcgctttcgctgaagaagatcattccctacacgacgcggccgatgcgccggggagagacggacggcgtggaatattatttctgcggagagaaggagctgtccggtcttctggaacagggaaaagtcattgaactccgggcatacgatacggtgcagggagtatggaagtattttacggtggatgaccatcagatacaggatctgcggcagaattatctgctgatcggtacgctggaagcatacgggaagctccgggactacttcggaaaggaacgtgttgttccgatatatattgaagtggaggatggaatccggctggagcgcgcgatcggaagagagcggcagcagcgggaaccgcactatgaagagatgtgccggagatttctggcggacgcggcagatttttcagaagaaaagcttttggacgcacagattacgatgcggtttgtgaatgatgatttaaagcaaacggaagaaaatatccgcgattatatattgtctcagaatgattgacggatcagggaaagagggtggcagattggatattaaggtgaatcaggcacagatggtgacgcaggtgccggacacggtgacgacggagaccggcgacggaacgttcaagttcacgctggcgagcgcgatcacggatgcagagcttcaggcgaaggtggacagtctgttatcggacattacgtttcaggggaaccggatcgcggaacatatggacatccgcgatatgaaaaagtaccgcggactgatccgtgattttatgaatgaagtggtctaccgctctcataagttttcaagagagaatttcctggaccgcaagggacgccacagagtctacggactgatccggctgattgatgccaacctggacgaacttgcacaggaactggtcaaggatgagaaggatcacatcacgatcttgagcaagatcggggagatccagggacttctgttggatattctgacttaacataaaacgagggaagctatggcaggatttaaagctattttagggcatgagcagatcatagagcatctgcagaatgcagtcacaatggataaggtatcacatgcatacatcataaacggaccggataagtccggcaaaatgatgctcgcggaggcgtttgcccagacactcgagtgtgagaagctggaggacgtggtgaaaaatgccgcgcagccgtccgacgtggagccgtgtatggaatgtcattcctgtaagcaggcgatgacgaagaaccagccggacatcatctatgtgcggcatgagaagccgaatacgatctcggtcgatgatatccgtacccaggtcaacaacgatatagtaatcaaaccttacagcagcagatataagatctatatgatcgatgaagccgagaagatgaacgagcaggcacagaatgcgctgcttaagacgattgaggagccgcctgcctacgcgattctgattcttcttaccacaaacgctgccgcttttctgccgacgatcttatcccgctgtgtcacattgaacatcaaggcagtgccggatgagaagatccgcggctatctgatgcgcaagtatcagattccggactaccaggcggacgtatgtgtggcattcgcgcagggtaacgtcggaaaagccattcagcttgcgtcctcggaggagttcaacgagttaaaggacgcggtgctccagctgatcaagaggcttcgggacatcgatctgtatgagatgacagaggcggtaaagcagatcgctacatacaagctttcgatcaatgattactttgatctgatgatggtatggtatcgggacgtgctgctgtttaaagcaaccggcgacgtgaacggcctgatcttcaaggatgaagtgtacgacatcaagcggcaggcagagaagagttcctacagcggcatcgagacgatcttagaggcgctgcgcaaagcacagatccggctcaatgccaacgtcaactttgacctcacaatggaactgctgttgctgacaataaaggagaactagaaatatggtaaaagtagtaggagtccgctttcggaatgcgggcaagatatattattttgaaccgggcaagctggacatccatgcgggaatgcacgtaatcgtggagaccgcccgcggtgtcgagatgggaacggtcatgacggagccgaaaggggtttcggaggaggatgtcatccagccgttaaaaccggtcatccgcattgcgacggaggcggacgagaagacggttgcgaagaaccgggaaaaagagaaggatgctttccgcatctgtcttgagaagattgccaagcacaagctcgatatgaagcttgtcgaggcggaatacacgtttgacaataataagctgttgttttacttcacggcggacggaagaatcgatttccgtgagctggtaaaagacctcgcagcggtattccgcaccagaatcgagcttcgccagatcggtgtgcgcgatgagacaaagatcatgggcggaatcggtatctgcggacgtgcgctgtgctgcaacacctatctctcggaatttgcgccggtttccatcaagatggcaaaagagcagaatctttctttgaatccgaccaagatctcgggtgtgtgcggaagactgatgtgctgcctgaagaatgaggaagagacctacgagtatctcaacagcagacttccgggtatcggcgaccgcgtgacgacggtggacggactgaaaggagaagtgtcttcggtcaatgtgctccgccagatggtgaaggtactggtagaggtggacgatgaaaaagaactccgggactatccggtggacgagctgaagttccgtccgcgccgcagaaaggaaaatataaagctttctgcaaaggagctgaaggaattgtctgcgcttgaggataagggaggaaaatccaagattgatgacaccaaataatcttgtccatgaaaacgagcgtctggatgaactgcaccggaacggctactatatcattcaggatccggcgagattctgtttcggtatggatgccgtgctgttgtcgggattcgcgcgtgccagacggggagagcgtgtgcttgatctggggacgggcaccgggattatcccgatcttaatggaggcaaagacggaggcagaagattttaccgcgctggagattcaggaagagagcgcggatatggcgagaagaagcgtattatataatcacctggaagaaaagatccgggttgtgacaggcgatatcaaagatgcctcgggaatattcggggcatcttcttttgatattgtcaccaccaatccgccgtatatgatcggacagcacggaatcagttccggctcggaggcaaaagcgattgcacgccatgaggttctgtgtaccctggacgatattctgcgggagtcggcgaagctgcttgtgccgggcgggagattttacatggtacaccgtccgttccggcttgcggagattatgagcaagatggttgcctgcggcattgaacccaagcggatgcagctggtctatccgtacgtggacaaggagccgaacatggttctgctggagggaagccgcggcggcagatcgagactgacggtggaaaagccgctgatcgtttataaggaacagggtgtatacacggatgaaatctatgatatctacggatattaacaaatgaacgggtatggcggcacagaaagcagcggacaggacgctgtggcagaaaggaaaaaaatatgtttaatgatattgtgataggaccgattaccattcatatgtatggagtgatgattgcagcaggttttctggcggcattgctgatgacgctgcgccggggcaaaaaaagaggctatgatgaggatatcatctggggcattttcttctgcgccatcatcggcggaatgctcggaaccaggattttatattatattgtagagattccggagatcctgaaagatccgtccatcctctgggatttcaagaacggctatgtggtctacggaggaatcatcggtggaattctggcaagttatatctactgccgcacgaaaaagcaggcgtttatgccgtattttgatctggtgatgccggcggtttcgtttgcacaaggcttcggccgctttggctgcttttttgcgggctgttgctacggcagggagacggatgcgtggtacggaatcacgtttcataactcctcgttcgcaccgaacggtgtgaagctgataccgacgcagctgatctcagcggcgggagattttatcatctgcgcgctgctgttatggtttgcatcgaagagaccgaagaccggacgcgttgcggcggcttatcttgtgctgtacggaatcggaagatttgccgtggagtttttgcgcaacgattacagaggcagtgtgggtgtgctgtccacgtcgcagttgatctccatcggcgcggtgatcggaggaatcgtactgtatttcgctgcaccgaagcttgcaggagtggggaatgtggccgaggagaagtctgtcggatagcaggcaggaatgcacgcgggaagtatacaggatgtgcgcgctttatgcacgacgaaaggaaaagttatggcgggaaagttatatttgtgtgccactccgatcggaaatctggaggacatcacctaccgggtggtgagaaccttaaaggaagtcgatctgattgcggcggaggataccagaaattccatcaggctgctgaatcattttgagatccggacgccgatgacgagctatcacgagtacaataagatcgagaaagcgtatcagctggtggataagatgcgcgagggacttgacatcgcactgattacggatgcggggacgccgggtatctcggacccgggggaggatctcgtgcgcatctgctatgaggaaggcattgaggtgacgtctctgccgggaccggcggcatgtatcaccgcactcacgatgtcggggcagccgaccagacggtttgcgtttgaggcgtttctgccgagggagaaaaaagagcgggcagcagtgctctcacagctggtcaatgagacgcgtacaatcattatctacgaggcgccgcaccatctgatccgcacactggaagaactgtatgggacgctcggggaacggaaattaaccgtgtgcagggaactgacaaagcggtacgaagaaaagacattaacgacattttcagagattcttgaatattataaagacaatgaaccccgcggagagtatgtcctggtaatcgccggaaagacatttgaggaattgaagcaggaagagcagaggaactgggagaacctgtcgctcgaggagcatatggaagtttatgagaagcaggggatcagccggaaggaagcgatgaagctggtggcaaaggaccgcggcatcagcaagcgcgatgtctaccaggcgctgttgtcttaaaaaatacttacataaatgaaaatactgtgttatattagaaaacgctgcaaacggggatgaccgtgttgcagcgttttttaccaatatcatattacaattcgcaaaaacattttggtttatgttggaaacgatacatgtgacgcataagctgcgccggggctattggggagccgcatccggcagataataattatccagatacgtttcaatgatcgaaaaaggtgcaggaccgatggagagcagagccttatgaaaagcgatatcgctgtaggcgcttccgtaggtttcctgtgccttttcttttaaatccacaaattccatatatcccacataatatttcagataatgggcgggttcttccacgatcagctcatagatttcgcgcagtgcggtctgatccgtgatgccgaagtctttccagaaagcggttgtgtcggaaaagctccagccgtcgtagtggattcccagatccgtcgacgcatagagactcaggagggcggactgattcagggagagcagcgaggcgaggtcatcgtccagcccggcataatggtacgagatcatctccacataggtcgcccagccctcgacatagcccggataattcagcagaaaccgcacgggatgcagtccggcttcataggacatcaccgtctgataaaggtggccggggaagccctcgtgcgccagcgttgtgaaataccgcagggaggaggtgtcggtggaggcattgataaatatggagttctgcgcataatcgtcaatgggcgaggtgatgtaaaacgcaggcgccatatagtcttccatgcactcgtcaatagaacttacagtaaatgtggtctcgggtggtgcaggaaaatttgcgcgcatcgcctcctgcagcccgtttagcgttgcaatgggatcggcggcaggaagccggacggtcgtctgggatgcttttaactgcgggttttcggagaggagtgctgccgcctgctgcaggtcgctttgccgtttttctaagatccggtcctgcagcgccggaagatcggaagcgctcccggtgttgtggcagaccaggtagcggtagtaatcttttccgtctgcaaagtaacagagccccatatcgtttttgccgctgccgagaagctctgtgagcgccgcggcaagatgggtgtaggcgggaagcacatgttcccgcaccagagcggcatttttttccttgtagagtgtcttttggttttccgtcaattctgacatggcatcgattttgtgatcgaaggtctggatgagatagtgttgatccgggtcagctgtgaaggcgttacactgtgaaatcagtgtgttgcaggcatagtcggacataaaaagcccggcctgtgctttctgctgctcgaagcggatgatctggtcgaaataatcgccggtcagggcgaggagcgcgagatagtcctccacgtcggctggctgccggaaacggtattcctcatatagtacgggaagctgcgactgaatgccggtcgtagggcgcagcggctcgtcgtagagagtcagatcggatgcggagagctccgtcttaagataatcctgcaagacgtcataggtgagctgaccggagggcggaagggcatcgcggtcgtattttgccagagccgcgagcgtgttctccagagatgcatgggatgcggcaagtgcttcttccgagagactgccgagcgtgatcggagtctctgtaatgccgtagttttccggatgggacagtgaaaaatgaagattgatcgtgttggaggagacctccgcccggaaaaaatcatcaagaaacgcatcgaaggaggacgtggaaccggcgacgaaatccgtctgcatggagaagcgggagcatccgttgagcagaaaaacggacgtcatcagtggaaaaaggacgaattgccgggaaaatgtgtggataaacgaagaatgcaaacaaacacctcgggaaacgcggcagtggagaaaactcctgtgccggaaaattaacatattctatgtgggaaaatgtgcaattattcaaaagttctgcgatgcttttgcgcatcaagggggtgctgtcaagatttattccgggatgcatatatatggagaaacgataaaaacgggtgaggggatatgaattatctttgggcatttatgattctgacgggcatcatctacggggcgttccacggaaccctgccgcagattacgacggcggcgctcgattcggcaaaagaggcggttacgctttgtattaccatgatgggagtgatgtctttctgggtgggactgatgcggattgcggaaaaggcggggatcattgagggactttcacggagaatgcgcccggtgctgcatttcctgtttccggatctcccgcaggagcaccccgccaacgaatacattgcgacgaatatgattgcaaatgtctttggacttggctgggcggcaacgccggcgggattaaaagcgatggaggcattgcaggagcgtaacctggaactctgcggacaaaaaggaacctcgcggaaacgcggaccggatattgccacggatgagatgtgcacgtttctgatcgtcaacatctcgtccctgcagctgattccggtcaatatcatcgcgtaccggagccagtacgggagcgtcaatcccgcagcagtagtgggtccgggacttattgcgactatatgtagtaccgcggcggcaattatcttttgtaagttaaaaaaacgttgctgaaaggaaacgaaaaaactataatagtacataggagaaacgcagatcgtgtttcaaggtacgggggcttgtatgggtagaagaaaatatgtactgatcgtagatgactgtcagcaggaccggatggcagtggcggatgttttgagatcggattacgacatcctagaagcatgtaacggaaagcaggcgttggagattctttccagaaaaagagcgcagatttcgctgattatgctggatctgatgatgcctgtgatggacggttatgaatttttggagatgtatcggaagcggaaggagtacagctatcttccggttgtggtgtgtacgacagaagacgaccctgagagagagcagaagagcctggagctcggtgcatgggattttgttctgaagaattccagccccgggatcatgagactgcgcgcaggaaacgccatcgagaaaagcaaggtgcggtttctggaatatgattttcttaccggtatttacggacagcagaagttctaccaggcgacccgcgaacttttagaccagcgcgcgggagcgaattttgcttttatccattttgacattgaccgtttccggattatcaataccctctacggctccaaagagggagaccggctgatccattttgtggcgggagccatccgcaaggtcatgacagcctacggcagaggcacatacggacgccttggcggcgatgtgttcggaatgtgtgtcccctacgaagatggtgcggtgatctatcacatactggaaggaatccgggcagagatccggaaacattccgtacattattatctggagacctgcgcgggcatttatctggtggacgatccggatatggaagtggcggcgatgcacgacaacgctgagattgcggcggcacagtgcaagggtcagtacatggttcacgatgttttatatacggaggagatcggacagaaagtgctccgcgaacagcatatcattgacgagatggatgccgcgctggcagagcagcagtttatcgtctatttccagccgaagtaccagctgaaaaagatggctccgtacggagcggaggcactggtgcgctggaagaagccgagcggtgagatcgtgcttccgaacgaatttataccgatctttgagcgcaacggctttatcacgaagttggactattacgtgtgggagaaagtctgccagttcatagacagtgagctttcccagggaaggaatccggcgccaatttcggtcaacgtatccagagtcaacctctataacccggattttatggattctctgattgacctcatccaccgctatcatattcctccgcattatctgaacctggaactgacggagagcgtcttttccgaggatgcggaattgatccagagagcggtgaattatctgcatgacgccggatttacgattctgatggatgactttgggagcggttactcctccttaaacattttaaaggacgtggatcttgatgtgttaaagatcgacatgaagttcttctctaaggggaataccgcggaaaagggtgcaaagatcatcgaggcggtcatccggatggcggaatctctggacatgatggtgattgcggaaggtgtggaggaaaagcatcaggtggattttttaaatgacctcggatgcgactatattcagggttattattttggccgccccatgtcgcaggatcagtatgagaagctgacgaatcacgatgaggaagagcagcatgacatgccgcagcccgaaagttcgtgaatatgaatatttaccgttcggattccatatagtagaataacggaagattctggatgtatcatgggcgtaatgatttttctatcggacataatgataccgcttctcattttcggtattgtcggttatggaattctgaacagacagaatatctatgaggagttcatagacggggcaaaggacggctttcagacggtcatcggaatcatgcccacactgatcgggcttatggtggcggtcgggatcctgcgggcttccggttttctggagtgcttttccgggctgctgggacgggggatcggctggcttggttttccgccggagctgataccggtcacggtggttaaaatgttctcgtcctctgcggcgaccggtcttcttttggatatatataaggagtacggcgcggattcgatgttgggaaagatggcatccatcatgatgagcagcacggagacgatcttttatacgatgtcggtctattttatggcggcggggatcaaaaaaagccgttacacgctggtgggcgcgctgatcgcaaccactgcgggaaccgtcgcaagcattattctggcgggatatatgtgagcagccggcggctgtggctgcgcccgggaaggattttttctgcaaaaatgtctgtgaaaacagaaaaatgaaaaaatcggttctataggatgtcagctctgcatataatgatagagtaaggcaggaaaaagcagggtgcggaagcggatttgacaagtgggtacgaaagagttataatacattatgttaacaagcaacggacattgtgatacaggaagcaatggtggttgcatatagcgcgggatggagcagtctggaagctcgtcgggctcataacccgaaggtcataggttcaaatcctattcccgcaactttttaggcagcagtcgcatgactgctgtttttttgctttatctaaaagacctgggttctgctgtagctgatgtttgcgttttagagaacgttttccggatctgcggacggaataccaatagattttggcgtgcggttggtgtatgatagagaaaatcgcagtgggatgggaggcgccagtcaatgacgaatatcgaacaatttttgcagatggtgaaggagtcggacaatattgtattcttcgggggagccggtgtatctacggagagcggaattcctgatttccgcagtgtggatggtctttacaaccagaaatatgactatccgccggagacgattttaagccattccttttatataaaatacccggaggagttttaccgtttttaccgggacaaaatgctctgccttgacgcggaaccgaacatcacgcataaaaagctggcggagcttgaggcggccggaaaagtaaaagccgtcgtgacgcagaatattgacggtctgcatcagctggcgggaagtaagcgcgtgctggaactgcacggcagcgtgcaccgtaattactgcaggaagtgcggcaagggatttgatgcggagtatgtgagggattatccgggaaaagtacctctgtgcgatgcctgcggcggtacgatcaagccggatgtggtactctatgaggaaggactggaccagcagacgctggaggatgcggtattttatatcagccatgcggatatgctgattatcggtggaacatcgcttgcggtatatccggcagccggtctgatcgattattaccggggaaataaactggtgttaatcaacaaatcgacgacgccgatggacgcgagggcagatctgctgattcaggcgggactcggcgatgtgttcgggcagattgaggtgtagacgggcgccaggcgaatgaaatttttttctaccgcagcggagcgaaacatgctacactatcactacattaggaaagtgaggaagaccatgaaccagtaccattatgaagtgggagacatcgtaaagctgaaaaagcagcatccgtgtggcagcagtgagtgggagattctgcgcgtcggcgcggatttccgcctgaaatgtacgggttgcgggcatcagatcatgattgcgagaaagcttgtggagaaaaataccaaagggctgcgcaaggcgggggagacggaataggctcgctgcgcagttttttgcgcttttttcaagaaagcacttgtaattacagggaaaacgtgttatagtagatactcgtgatataataattattccttgctcatgtaatgaaaacgtgggccagagaccaaaaggaggaaattcgcatgaataagtatgagttagcactcgttgtcagtgcaaagatcgaagacgatgcgagaacagctacagtagagaaggcaaaagagtacatcactcgtgccggcggtactgtaacagaagtagaggactggggtaagaagaagttagcttacgaagttcagaagatgagcgaagcttattactacttcattcagttcgatgcagagccgactgttccagcagaagttgagcaggatgttcgtatcatggacaacgtacttcgtttcttagttgtgagaaaagacgagaaataagagattctttgatctgataacgtttgtttgagggaagagaggaatcgtatatgaacaaagtgattcttatgggaagactgaccagagatgcagaggtgcgttactcacagggtgagaactccaccgccatcgcaagattttcgcttgcggtagaccgccgtttccgtcgtgacggggacgagcagacagcagattttatcaactgcgttgcatttggcagaactgcagagtttctggagagattcggacgtaagggaactaaattcgttctggagggacgtattcagaccggaagctacaccaacaaggacggacagcgtgtatacacgacggacgttgttgctgagaatgtagagttcgcagagagcaagaatgcttccggcggcggagataattccggttttaccccttccgacagaccgtcaccgagcagtgcagcgggtgatggcttcatgaatattccggacggaattgatgaagagttaccatttaactaatggacgataataacaggaggtaattatcatggctttcaataaggcagcagacaaagaaggcgctccaatgaagagacgcccgatgcatagaagaaaaaaagtttgtgtattctgtggtaaggacaatgtgatcgattacaaggataccaacaagttaaagagatacatctctgagagaggaaagatccttcctcgccgtatcacaggcaactgtgcaaagcatcagagagcgctcactgtagcgatcaagagagcacgtcacgtggcattgatgccgtacgtatgtgaataaacttcgtttaatcacagcgaataagctgataagtaaaaagaccaacaatccttccgattgctggtctttttttaggtgattgcattttcgtaatgtcgctgattctaaaactttccttaagaatagaaaaatgggcttggaaatgagacaagaatcatataatattatgggtatgtgtaagagcaagaggtgcagaggagtgggaacgcggatgagaggacactggtacaaaacgacagtcatgctgacaatggttctgatgctggcaggatgcggcggagatggcgcagaggcagagcagacggtgcagaccgagcaggtggaacagacggagcagacgcttgagcaggtgctggaagagcatttccttgcggcggaggatgcggaggatgtggcgacagtggtctcgcagtacgcggaggagacgccggatccggcgctagcggagtttctgatctcttattatcaggttccggacgaagagcagagcaagacccggtattactataatcatattgatctgaatgaggatggaacagatgaaattttcgttgtcgtggtcggtgagtatacaaaggtatcgttcggtgatccggcgctgatcttatcggaacaggcagacggaacgttccaggtgatcgagtcgtttgagggaatccacacgccggtgacggttagtgagcgcatgacgaacggctggcatgatattatttaccaggaatacggtcgtggagcggaagatggataccgtatctgccattataatccgaatggaggataccagacagatctgagtgaggttgtggatgaggtggagccgcaggacggcacccagatcatctccaacaactttatcgacgatatggataaggggaattatatgacgctcgcgccggcggaagatggcggaagcgaagcgcaaggcaactagataaagcgcaaaccaactagatatagcggctgaaattttggactgtccaacttgttgtgggcagtcttttttcgggcaaaaaaggctttatattgggcggtcaaaatggtataatgcacggtatgatagtgtttttgtatagaatgatggaggcttgcttgtgagaaaaagtaacgtaaagattaaaggaaagcttcgtacatatttgtatctgccgctgctgcttacaatgcttctgattatcatcaatgtgtttgtgtatatggaagacacttcttcgggagtgcttttttctgggtttgtactgctctattttgtgatcatgctgatcgcttatctgcgcaataagccgcttctgatcgatgagctgatcaattttgcgacgcagtacggtctcgtgcagaaacagctcttaaatgagtttgaaatcccgtatgcactggttgattataatgcaaagtttctgtgggtgaatgagcagtttacggaggtcacaggaaaagacaagaagtatcataagtcggtcatgacggtattcccgacgctgaccaaggagctgctgcagcggagcgagccggtggagtcgatcaatctgacatacaatgaccggtattaccgtgtggcgttaaagcgcatttattttgacaccatgacacacgacagcacgatcgtatcgctcgatgagagcaatgaatatctgacggcgatgtacctgtttgatgagacagagttgaaccgctacatccgcgagaacgaggaacagcgtctggtggcggggcttgtatacatcgacaattatgacgaggcgctcgacagtatcgaggacgtcaagcggtcactgctcgtagcgttaattgaccggaaggtgaacaaatactttacagagattgatgcactcgtcagaaagatcgagaatgacaagtattttgttgtctttaagaatcaatatctcggaaagctccgggaggatcgtttcagcatcattgaggacgtcaagacggtaaaagtcggcaatgagatggcagtgacgctcagcatcggtatcggcgtcggcggcgattcctacaccaagaattacgagtacgccagaatggcgattgatcttgcactcggacgcggcggcgaccaggtggttgtccgcgacaacgaggatgtgacttattacggcggcaagaccaacaagcaggtggagcgcaacaaccgcgtgaaggcgagagtcaaggcacatgcgctgcgggaggtgattgagagccgcgagcatgtgattatcatgggacacagcatcagcgatgtggattccctcggtgctgcgatcggcgtgtactgcgcagccagagtgctcggcaaaaaggcgcagattgttttaaatgaggtgacatcttccctgcgtccgcttgtggaaggattttccgaggaaaaaggctatccggcggatctctttatcaagagcgaggaagcaattcttctgacgaaccgcgatacgctcgtgatggttgtggatgtgaaccggccgagttatacagagtgtccggagctgttaaaacgcacggatacggtgtgcgtgtttgaccatcacagacagagcagcgaggtcatcgagaatccggtgctttcctatgtagagccgtatgcgtcgagcgcctgcgagatgatcgcggaggtgctgcagtatttttccgagaatatcaagctggagccgcatgaggcagactgtatctacgctggtattctgatcgacacgaacaactttatgaccaagacaggtgtgcgcaccttcgaggcggcggcatatctgagaagagccggagccgaagtgacgcgcgtgcgcaagatgctgcgcaacgacatggcggcctacaaggcaagagcggaggcggtacgccacgcggaggtttaccgcggtgcatttgcgatctccgtgtgcccggcggataatgtggagagcccgacgattgtgggcgcacaggcggcaaacgagctgttaaatatcgtcggtatcaaggcatcgtttgtgctgaccgaatatcagggcaagatttatgtcagctcacggtcgattgacgagatcaatgtgcagctcatcatggagcggctcggcggcggcggtcatctgaatgtggcgggcgcgcagttgacagactgctcggtgctgcaggcaaagcacatcattcaggatacgatcgacgagatgttaaaagaaggcgacatcgaggaataatacgatttgggaaatacaagataagcgcagcagaatgcgcggaaatgaggatcatatgaaagtaattttattgcaggatgtaaaggcattaggaaaaaaaggcgacgtggtgaacgtcagtgacgggtatgcgagaaatgcgattttcccgaaaaagctgggacttgaggcgacaccgaagaacctcaatgatctgaaattgcagaaccagcacgcagacaaggttgcacaggagaattacgaggcggcgcttgcgcttgcggaggaattaaaggataagaaaattacggtcaagatgaaagccggcgagggtggacgtaccttcggatctgtttccacgaaggagatcgcggcagcggcaaaggagcagctcggcatggagctcgacaagaagaagatgcagcttccggagccgatcagaagcttcggcatgacagaggttgccatcaggcttcatccgaaggtaacgggaacatttaccgttcatgttgtagaagagtagcaggaggtttatttcatggaagaggcactggtaaagcggattatgcccaacagtcttgaggcagagcagtccgtgatcggttccatgattatggataaggatgccatcgtgacagcgatggagatgctcatcagcgaggacttctaccacacgcagtacgggattttgtttgatacgatgattgaactgtacaacaagggtctccctgtggatctggtgacactgcagaacaagcttaaggaaaaagatgttccgccggagattgcgagtctggagtttgtgcgggatctggtgacggcagtaccgacttcggcgaatgtgaagtattatgcacagatcgtcaaggacaactcgatgcgcagaaagctcatcaagctgaatgaagagatcgagaatgagtgttatgtcggcaaggaaagcgtcgagacagtcatggatatcaccgagaagaaggtattcgaccttctctccacccgcggcggaggcggcgactacgtgccgatccggcaggtcgttatgaatgccctcgagaagatcgagaacgcggcaaagacttcaggaacggttaccggaataccgaccggatttattgatctggattatcgcaccgctggtctgcagccgtccgatctgatcctgattgcagcgcgtccgtctatgggtaagacggcgtttgtactaaacattgcacagtatgtggcatttcacgaaaatatgtgtaccgccatcttttcgctcgagatgtccaaggagcagcttgtcaaccgtctgttttctctggagtccagagtggatgcgcaggcgctccgtactggtaatctctcggatgcagactgggagaagctgatcgagggagccggaaccatcggtaattccgagctgatcatcgatgatacgccgggtatctcgatctccgagatgcgaagcaagtgcagaaaatataaattagagcatgatctgaagctggtcatcatcgactacctgcagctcatgtccggttccgggaagtcaacagactcccgtcagcaggagatttcggatatttcccgatccctcaaggcgctcgcaagagagctttccgtgccggtgattgcactctcccagctctcgcgagccgtggagcagcggccggatcaccgcccgatgctctccgatctgcgtgagtccggagccatcgagcaggatgccgatgtggtaatgttcatttaccgcgatgattattacaaccatgattccgatatgaagggaatctcagagatcatcatagccaagcagagaaatggtccgatcggaaccgtcaatctggtatggctgccgcagtacacaaagtttgcgaatatggaaaaataataggatggaactgcagcaataagcatagacatcttttgggtgataagtaatattattagaaatagatacttaaaagttccagataaacatgcggcggcaaatctgaccgcaaaatctggtatttctaaccatgccgcagctggcatccgtgatgatccatgtctttccaagtttggagcactctacggattgtgtccgcaagccggcagacaattttaggacttttgtgtgtgtcccttatggccacctctgaacaaaacataaccgcgcgaagccgatgtctgagtcggcatctgccttattttcaatagcagatgccgacgagtttcggttcgcgcggttttatattgtctgtgaagaggtgccattagggacaccagaaagtccgctcattgtctgcggcttgtcggacacactcctagagtgtccaaacgtggcaaagacacggaatgggatgccagccgcggtatggaagaaatacacgaattttgcttcaaagattttgccgccgtctgtttattctggaacttttttgtctctggttttcctgtaatattacttatcaccccaaagcgcgatatgcttattgcggcagttccattcttatggggagtaccttacacaggtatcaagaaagagtacaaaaacgggctgcggcgtatggaaacgttgacaatcgttgaaagcggcggtttggcatgttaccattggaaaatgtctcacattacgatccgaagcaaaacaggaggaacagatcatggatgcgaatataacaggactgtcggcgcgggaagtgacagaacgccgcgagcgcggggaaggcggcgctgccgcagagcgtattacaaaaagcagggcgcagattgtccgtgaaaatgtatttacattatttaatttgctgaactttatcattgcagggcttttatttgccgtgggtgcttacacaaatatgctgtttctggcggtaatttttttaaatattgcggtcggaattgcacaggagctaaaggcgaaaaagctggtggatgaactctcgattctaaaccgtccgggcgtatgtgtgcgccgcggggcaaaggacattcaaatcgagctggatgaggttgtaaagggtgatttgatggtgttgcagagcggcaatcagatctgcaacgatgcggtggtcgtggaaggcatgctggaagtgaatgaatcgctgctcacaggagagagtgatgcagtggtcaaggaggctggaagtgagttatattccggaagctctgtcatttccggtaaggcatatgcgaaggttacgcatgtcggaaatgaaaattatgctacaaagcttgccaacgaagtaaaaaaggaaaaacgcgtggcatcggaactgctgggctctatgaataaggtaacgcggtttaccagtatgctgattgttccgttgggtgtgattctgtttttcgaggccttcctgctgcggcaggcgcccatgcgggaagcggtggtgtcgtccgccgcggcgcttcttggtatgctgccgaagggactggtacttttaatctcgatttcactggcgaccggagtcatccggctggcaaaaatgaagatcctcgttcagaatatttactccctggagacactggcgcatgtggatacgctgtgtctggataagacaggaacgatcacaaacggaaagcttacggtggacgccgtcatggagatcagcgcggggctctctggaaaggcgttgccgcagggcgaaccggaaaaactcgtgcagtcgtatctggcggcctccgacgacaacaatgcgacattccaggtgctgaaagaggcgtttggcggtcaggcattttatacaccggcacataagattccattttcatcaaagcgcaaatggggatgtatcagttttgcgggatcgggcagtgtttttgtcggcgccccggaaaagctgatgcgaaagctgccgggggaactggaacagaggctggaagagggctgccgggttatcattgtgggctatgtcccgatgcagtgggaagacgaagcggcgctgccggaagagatacagccgctctacggggttgtcctggaggataccatccgtgagaacaccagggagacgcttgaatttttccaccgggaaggcgtggacgtcaaggtaatttccggagatcatgtcaagacggtctccatgattgcaaagcgggcaggactgcaccggtggaaggatgccgtggatttatcgacgctcggagaggacattgattatgagcagatctgccagcagtacgcggtgtttgcgagagtgacgccgggacagaaaaaggaactggtgtgtgcgctgaaacgacagggacaccaggtagccatgacgggagacggagtcaatgatcttctggcgctgcgggaggcggactgctccatcgccgtggcggacggaagcgatgccagccgccagatcgcgcaggtggtactgctggattccgattttaccaatcttccgcaggtcgtgatggaagggcggaaagtcgtgaacaatgtcacaagaacggcgagcgtcttctttatcaagaccatctactcggtgctggtttcggtgatctgcctgctggcaaacattccgttcccgtttatcccgattcagattactgtgctggatgcggcaatcgaggggtatccgtcgttctttaccatctgggaatccgacacgcgcaagatacgcggcagattcttaaagacggcgttatccaatgcgctgccgtttgccctcacagtcacggcgatggtcgcagtcaccagtatcattgcaccgtttacggtggagcagcggcagacagtcatgtattttctgctgatctttatttccatggcagccgtggtgaagagctgtattccgtttaacggcctgcgcaccttcatctgcatcacgatggtgataggaacctttggcggtctcgccatcctgccgtcgctgtttgagatcagcgcgattaccgccgggatgggaaaataccttcttgcggggggaagcttatctgtcgtctgtctgctgcttttgcttggaacacgcggagttctcggcagaaagagattgtcagaggcagaggcggtgcggtagagaaccggttttccgttatattttaatagaaaaagaaaagcagagatacctttgatgcatttggtaatgcggtatctctgcttttttggtatagtaaaaagacagggggtgaagcggaggatggataaacgcagcacatcggaagaacagaaaagcggatacctggggctgaccagggcagacgaggagcggcatttggcggacgtgatctcggttgcacagcagaatctggaacgcgccggggcggacatacgcaaggttaacgaagatctggcggatcttctcgagacatacgacgtgaaagacaaagaaggccttgcactctggaataatgcgacggcaagattaaaggaaaatgaatacgatctgatccgctatgagaaggcgagaaaaaagccctacttcgggagaattgattttaaggacggcatctcccaggaggaggagacctgttatatcggaagagccggaattgcgaaaaacggctcagagccggtggtgctggactggagagcgcccattgcatcggtatattacgagagcagcatgggaccctgcacttatacggtaagctccgagggaacctatgagatggatctggtgcacaagcggacgtacgagatcgaacaggatgtgctgaaggatttcttcgactcggatgtcgttgccaatgatgaacttctgacaaaataccttgcaaaaaacaagaaagcggtattgggagagatcattgcgacaatccagaaggagcagaatgtcatcatccgccgctcgccgcggacgaacgtcatcattcagggcgtggcgggttccggaaaaacgaccgtggcaatgcaccgcatatcctacattttgtataactataaggatgatttccggccggaggatttttacattgtgggaagcaaccggatccttctgaactatatcacgagcgttctcccggaactggatgtgtatggaatccgtcagctgacgatggagcagctgtttgtccggcttctatatgaagactgggacgatgcacgctactcgtaccacagtatggagagagacgatccgaaaaacagtgtcaagtgcgatacggagtggttcctcgatttaaaaacatactgcgaagaatatgaaaaagagagcgtgccggcggaggacgtttatctggaaaagacaggaaagcttctgatcggtgcggatgagatccgccgctatctaaaggagcatccggcggactccatggagagcaaaatgctgatgctgggggagattgttcattccagatatgagaatgagatcctgggaagagacatcacgtttccggcagaagagaaaaagcggctcgaccggaaatacacgatgtactttggaaagggaaaatgggagggatcggtctatgccttctatcaggatttcctggcggcgcaggcagcccgtggcagggaagtaaccccgccggggaattcctttgacgtctatgatctggcggcgctggcctatatctacaagcggatcaaggagacagacccggttagggaggcgagtcatgtggtgatcgatgaagcgcaggacttcgggatgatggcataccggtgtatggatgcgtgcctgtcggactgcacctacacgatcatgggcgatacctcgcagaatatccattttcagtacggcctgaatgactgggatgaactgcgcagactcatcctgaccggcgattatgacgcttttgggcttctgcggaaaagctaccgcaacacggtggagatctctacatatgcgaacgagattctgcgccacggggatttttccatctatccggtggaaccgatcatccgccatggcgccggggtctgtgtggaaccggtgcagggagagcgggcgctgcttaaccgggcggcggagacgatacagggctggcagagaaaaggatacgagaccatcgcggtgatctgtcgggatgaagaggaggcagagcgggttgcggctcggctggcagaggacgttccggtaaagaacggcgcaaaaggagagacggaggagttcggggacggcgtcatggtgcttccggtatcctacacgaaagggctggagtttgacacggtacttctgtttgacccgtcggagaaaaaatatccgtcggacaacggtcatgtaaagctgttgtatgttgcggcaacgcgcgcgctgcatgagctgacgattctccatcggggggagttgtccggaattcttgcgggcagggcgccgcaggataagcatataaaggaatttgcggcggaaccgctcacaaaagccagggagtatgagaagcctgtccggacaaaaaaggaacagatgcagcagcgcagggtggaaggcgccatggatatggcggagcgggaatatttcggccccagacgcattgcggcaaaagcgcctgcggcggaggagaaaccggtcataagaccggcggcatcaccggcggtccgtccgcagacagagacagtgcgcgggcagcaggcaaagacagtgcaccgtccgcagaccggggcaatgcaccgtccacaggcagagacagtgcgcgggcagcaggatatggcgacgtctccggcgccggcagggaagcgtccgggaccggagggaaccaatccgtccccgtatgcattcgggacgatcccggagaataccagtctgcgcgtccgggggcacgcaaagggaaatcatgcggtccggtgggtaaaaaagagcagatcctatgtagagatggcgagcatgtacgggctgatgcggattacgccggtcgctccggacatcatccgggtcagctttgtaaaaggagtgacggaaaaaattgcagctacgggctggatggccaaagcggaggaagcgttttcatggagcgccagggaatccaaaagcgttgttgagattgctgcgggtgagattacggtgcgggtagataaacggagcggagcggtctctttctggaacagggagaatcagcttctgcttgcggaaaatgccgcggagccgagagtgatcggcgaggagggaagctgggtatttttcgactgggacaagaaagagcgcatcaaggcaaagggcatgctcgatacggattttctggatgtgacattaaatgcgcgttatatatccttcggagggaaaaagcatagaatgccgcttgtgctgtcgaaccgcggctatggcatcgctgcggcggcaaaaaatacggtgctgctctgcgatattaagacgtacgggcaatatctctacgcggaaggcgagagacagctcgactactattttatctgcggggagaagccggagaatgtcatcacacgttataaagggttataggaagaatttacgtttacattttacaaaaacctcttgacttggagtgaactccagggcttacaatgcctaacgaacagagagttccagggcaccggaaaggagcagaggacatgacaattaaagaaatcagtgagaaatatcatattaccgcggatacgctccgctactacgagcgagtgggaatgattccgccggtcacacggacggcatcgggaatacgggattacggtccgaaggatgagagctgggtttcgcttgccatctgcatgcgcagggcaggtctgccggtggaggcaatgattgaatatgtaaagctttttcagcagggcgataagacgatccctgcgagattgcagcttctggtggagcagcgggaacttctggaggaacagcagcggcagatcgaggagaccaggaaacgtctgaattacaagatctcacgctacgaagaggcaatgaaaacaggaaaactgacatgggaggagaacgaaggatgtcatacgaattttataacccaacaagagtcctgttcggagcaggacagttaaatcacttacacgagcagaagatgcctggaaaaaaggcaatggttgtcatctcaaacgggaaatcgaccagagcgagcggcgcacttgaccgtacgatgaaagagctttccctcgcaggtgtggaggttgtgctgtttgataaggtcggagcgaatccggtcaaggagatcgtcgaggaaggaggacattttgccaagaaggaaggctgcgatttcattgtcgcactgggaggcggctccgttatggacgcggcgaaagtcatggcaatgtatgcgcagcagccgggagatctctgggattatgtggcaggagcaaccggaaagcagcagccgttagtgaatccggtacttccggtcatcgcgatcacgacaacggcaggaaccggatccgaggtggatcagtggggcgttgtgaccaatccggcaacaaatgagaagatcggctgcggcggcatggatgagctgtttccggtgattgcggtggtagatccggagctgatgctgaccgtaccgtcaaaattcacggcataccaggggtttgatgcgctgttccacagcgtggaaggatacctctcggttgtgaacagcctgatgtctgagatggtccagcttgcggcgatcgagaatatcggaacctacctgccgcgcgcggtaaaggatggcagcgatctggaggccagggagcatgtggcatttgccaatacgatgtccggctattcgatggtggtcggttcctgcacaagcgaacattcgatggaacatgcgatgagcgcatttcatccggcgctgccgcacggtgcgggactgattatgatttcggtggagtattacagacactttatcgaaaaacactgctgtgatgagcggtttgtccgcatggcgcaggcactcggcatgaaagatgccaaggcgccggaggattttatcacagcgttaaagaaactgcaggaggactgcggcgtatcagacttaaagatgtccgattacggcatcgaaaaagaggagagcatggttctcgccaggaatgcaaaggcgacgatgggtggactgtttgcctgtgatccggtgccgatgacagacgaagagtgcgcggcgatttatgagaagtcttaccgctagagaaggttgttttaaacattttaacttatagaaaaaagagttaagaatggaggattatgatgagtcagaagagtcttgtagcttatttttcatgcagcggcgtcacaaagaagacggcagagcagctttcggatatggcaggagcggatctgtttgagattcgtcccgaggtgccttataccaaggcggacctggactggatggacaaaaagagccgcagcacggtggagatgaacgatccgtcctcccgtccggcgattgcggacaaggtagagcatatggagcagtacgacaccgtctatgtgggtgcttgagttataattgggacaagttagaagaaacccagtaaaatcaaggggttggaactaatttagtccttatttttatacctttaaatcggtacaggatagggcagcgctgacatatcaatccgaaatatgaccattacatagagcagttcagattcatgggctgagtgtgctttgtgtacccaagagaggtgaaaattgaatagtaataattttaggtaggactaaattagctttgcactgaaaagtgtatccggctgtttgtcctgccttttttattggaaatgagcaggagatggcagaaaagaagctgatttggtctgaatgtaagtcatctcgcaaaaagagaggtggctgtatatggaagtattgtcttatgaaagcaagagcagagtgtgatcgaatataaatcgctggcagatatttcagagacaaggaaaataggatagaaacacaaaccgaaaggtacgggtagctgtatgaacaaaattagtaagatttggaggaacagaaaaatgaataacaagttagaagtaataggaattgatcacggctggtcaatgatgaaaaccgtaactcaggtatttgtcacaggggtaaaggagattacaactactccggcactttttggagatgttcttgagtacgacggtaagtattacaagattggaacagtaaggcaggaagtgaaagatacaaaggttgaagatgacagcttttatcttttgacactggcagcagtcgcaaaggaattgaagaaaagaggattgtcagatgcaaaggtatttcttgcagtaggacttccacttacccgatttggagcagagagaaataactttattaaatacctgaccaagaataagcgtgttgatttcagatatgaaaatgaagcataccatattgagattgacgatgtggcggtattcccacagtgctatgcggctgtggttgacaagataccgactatggcaaagaaaacgctggttgttgatatcggtagctggacaatagatattatgcccgtgattaacaagtcaccggacgaatcaaagtgtgttaccgtgccaagaggacttattacctgtatgcgttctatcaatgagcagtgtgtaagacagctcaatggggaagttgatgaaacagaaatccagaatattatgcgatatggcaggtctgatatagatgatgaataccttgcgattatcaaggctgagatagaggactttgttgaaaaggtatataactcaatccgtgagtttggttataaccttaaaactacaccgattgtatttgtaggtggcggggcagtggtaatgaagaatttcagcaatcacgaagcaaagaatatctcttatatccttgatgtaaaggcaaatgccagaggatatgaacagcttgccattatgggattgaaaactgctaagagacttgcatagggggtagtcatatggcacgaaggcatattatggagagcacattccgactgaatctgctcaatcctcaacacgctaaaatcaatgaggtcataaaggggcttaatccaaagatatataagtcaaagaatcagttcctgattgaagcctgtgagttttatattgaccactatggagaggatgatattccctccaaagaggaaaagagatatgaacagtttgtaacgagggacgagatagaaaagataaaaaaggaaattgagtattctgcaatgagtgaggcaagaaaagaggtcatttctttacttgggggagctttggcgggagtgaagaacagccagccggtagtgattgcaaacccacaggaagatatggaagaacagccggaagaagatgttatgaatgattcagatgttgcaggattggcaatgggatggatgttgaaaggagattgattattatgagaagaattgcaggagccgtaggaaccgctgttttacaggtactcaagtggatgctgaaaattgttcttggagcattcaagctgttcttgggacttgtcaggttagttcttcttctattctgtctggtagcaagagcatttctttcattcgtaagaatgggaacattttgaggggaggtgagactatggaggtaaaaggcttctttcctgcttacaggaaaaacagaagacttgtgaagtatttctttaaatttaagaaattgttataatcaaggaggttaaaatgcacagaatacgggattgtccggaatgagctgacgggtatatcaaagagaaaataaaaacaatcaaccttgcgggggaatgtaagccaatgacttatgttcccccgctttttttgtttggaggataagcagatatgatgaattatgagatttttaaggaagtagtaaaagagaagtttatggactatatgccggataacttcaaaggtatggagcttgtagttatgcctgtggaaaaggtaaatatgacctatgacggtatcagtatcagaggcaaagatactaatatttctcctactatttatatcaacgatatgtatgagaaatatcagaactgtggtgatctggaggaaacactgatggcggcatgtgaccttatggcaatggagtttgcaaagacaccacaagttgttgatgttgacagcttatacaaagatgccaatgaaaaggtagtattccagcttatcaatacggaacagaacaggtcatttctggagcaggtgccacacagagaatttcaggatctttccattatctataaacttgtgataaatgcggatgctgaaagtattcagagtataaaggttacgaacagccttgcggaaagatttggaatgaatgaggagcagctttttaaatatgcggctgaaaacacaagaagaatcttaccgccaagaataagaaatatgaatgatgttatgaaagagatgtttttaagtgacgggatgccggaggagatagcagagatgatgatcagggaagttccaccggagcagactctgtggataatctccaataacaggggaattgacggtgcagtatcaatgctttatgagaatgagcttcacgaactggcagaaaaccttgaaagtgatctgtatatcctgccttcaagtgtgcacgaagttcttgcggtgtctactgagctgaccgaaccggaggagcttgcacagatggtggcagaggtgaatatgcaggaggtggcattggaagaacgactttccaatcaggtgtatcactatgataaagatttaaggaaactcacacttgcaacggatacaccgaacaagagactggacggtatcgtggcagagccgcagcttgtatatgacgcaaaggaaaaggcgagataggaggcagttatggagcaggaacttaccgtagaagaactgattgctcttgtaaacagccagaaaggtgactttattatccgtattgagtttggagaggaggcggattcctgtgacagagaagaacgacttcaaacttgatgttgtatccataaggcttgtaaaggaggctccgatttattcggagcagtcctttaacaagccggaagaagtagctgccgtaatgggagaatgtatgtgccagttcgacagggaagtggtgtgtgttgtaaatctcagctccgacctaaagcctattaatgtgcattttgcaagtgtgggttcgttgaatgaagcaatggcacacccaagagaattatttaagtcaagtattttaagtaatgctgccagtatgatgttgatccactgccacccgtcgggaaatatatttcccagcaaggcagacacgatgatgacggaccgtatgaataagctgtgtgagcttattggaatccctcttttggatcatatcatcgtgggaggggataaccgtgccttcttcagtttcaaggaaaagggaatgattgataatccaagaattacactcagtacggattacaggaaccttgatattaagtcaccgcttgtggcagagcagggaaaggcaaggtgagagtatggaaggaagatttacagaggaggaacttgccatagcaaagagcgtagatctttgtgccgttgcagaaagtctcggttataccgtaaagaggattggaaaatatcacaccttaaaggaaatggactcaatccgtatctatgaccgcagtcattggtacagatggtcaaggcagtttgataagggaaataatggcggctcacagatagatttcctccgtgtatttggcggaatgagtgtaaaagaggctgtattctggctcttggattttgccggataccggagaattgaaagcacgggaaagcagccgcttgttcatcaggtcacaaagaaacagccacaggaaagaaagccttttgtgcttccgcagccagcaggggataattcctacctgatatcctatcttaacaatgagcgtggaatcagtaaggcagtgatagaactgtttttaaaggaaaatctcatatatgagagcaggcattatcacaatattgtctttaaaggaaatgacaagaatggagtaaccagatttgcaagtatgcgtggtgtatttgataaacagggaaaaccattcaagtgtgatgtggaggggaatgataagaactatggatttaatgtggtgaatgtaaacagtacagagcttgttgtattcgaggcagcaatcgaccttatgagctatgtggatatatttgccgaccatgaatcaaataagctggctcttggaatgcttgcagatgccccgcttgcaacttttctcagggaacacccacagatttcttttatccgtttctgccttgatggggattcaccgggcaggaaagcagccgcagaacttatgggaaaatactatggactgggctatgaggttgaggactgtccgccaccagcaggctataaggattacaatgaatggcttgttgcaacaaaacttaatcttgcagatcagaaaaaggagcagatgaccatagccggacagtgccattaaaaagtggtggtaaaaagcagtggtttttacggaagatggtggaacaaagcggtggttttttcaaaaagtgatagaacaaagtaccaccactttccgatgctgttttttcctatgaatataaattataaaaagtggtggcataaagcggtggtttttaccggaaatggtggaacaaagcggtggttttattcaaaagtggtggaacaaagtgccaccactctatatttggcaggggtattaggggaatgttcccctaactagatggcattaggacagagatgtctctaatgcgtatctagcagtcgccggggacttaccggtgactggagccatagtgaatatctacgaaacacggataaggaggtgcaaggtggcagagaacagggaaataacacttttttcagaaccagaggaactgattgcctgggcagaagtatatgataagcaaatcaacccttcgatagaagatgctgcacttcttcttaattatatggaaggacatgattatgcaatcggaatggatgcagaggggaagatgtacagacaggatatggcagaggaaaacggtgagatagagccatttccgatagatgatgtgattgataaggtgtgtgagtggaattatgatctgatacttcacgcagaggcaaagaaagatgatccgaaagattttcaggaatattgcgaatttcagaaaaagtatgacagtttaaaggcagatgagagggtgttagaccgattatttgataaaaccagtcatgcaaaggagattgatgctgttgcaacggcactggtggaagcgtttatcagtaatctggagggcaagggtgatttggaaaaggcggcagccacgatagcacaaggaataaaggattacagtacagataagaggggaaggtgagcgtatggcagataaaatccactgtatcaggaaaacgctccgtcttatgccgcaggaggcagaaatgcttgcaaaaaaggcaggggagagcggaatgtgtgaagcagattatttaagactgctcatcagccagaaaccgaatgattacccggaagtcagggaactcttaaaagagcttatcaatgaagtgaaccgtattggaatcaatatcaatcagatcgtattcaataacaatgcaggactttattccaaagaggataaaacacagcttgttgcctatatgcgtaaactgaacaagaaagtaaatgaggcggtggtgcagattggcaatcagtaaaatccttaatatgaaagattgtggcgggcattttcacggaaaacatttaaagcgggcacttgattatgtgatgaacccggacaaaacacaggatggcagactggtgggtgcaataaactgtcaggtcgataccgcatttgagcagatgaaggaaaccaagcgtaattttggaaaaattgataagcgtcaggggtatcatatcatactttcctttaaggaaaatgaggtaaatccggatacggcatttgaaattacacagaaatttgtggaggaatatcttggtaagtcatacgaagcggtgtttgtggtacacgataatacagcccatgttcattcccatatcgtatttaacagcgtgagttttgtggacggtaaaaagtaccgttacgaaaaaggggactgggcaaagtatatccagcctatcacgaacaggctgtgtcaggaatatggactctccattattgatgtggatgatgagaaaaaggagaggcagcacgaaagctataaggaatggagtgagtacagggagggtaattttgtatggtccgatatgataaaaagagacttggatgcctgtattttgcaggcgaaggactatgaggaatttctcgaactgctgtctgaaaagggatatcagataaagcagggaaaacatctggcaatcaagccacagggtatgacaaggttcagaaggtgcaaatctcttggggatatgtattgtgaggaagcaatccgggacaggattgtaaaagaggatattgcgttttataagagtaaacaggatataccgaaagtttccattgtaaagtgcagagttaaaagataccgcagggcaggcttgtcaggacttcagaaaaagcattatgcgaagctgtaccgggtgggaaaactcaaaaaaagaccatacagtcaggtatggaagtacagggaggatatccgtaaaatgcacaagctgcaggaacagtatttgttccttgcaaggcataatatccattcagcagaagaacttgtggggacgatagcttctcttacggataagaaaaaagagacttcggcagaaaagagccggatttataaagcaagggaaaggagcatggaactttttactgcggctgatgagatggaaaacttaaagccagcagagcagtcatacaggcttggagatatcttctttgaagatgagcataggaagtgggtggcactggagcaggaattacaggcacagggatattcgcttgaggaagtgcaggctttaagaagacattacaaagaggagtattcagaagtgtgtgcgagagaaaaggttgtatgcagggaactgaatacgggtaaggcaatattaaacagcatgatcccggacagtatttcagatggaagaaagaccgaatacaacagagagattataagagacagaaaagagcagccagtaagataggctgtttttttacgcagttaggaggagcatatggaacaaaatctgaatgacaagccgttaagcaatatgcagattgccagatatattgagtcattgagaaaagaaatgaatttcgatgatgaggtgtacgggcttgtaaaaagtgatcttgaggatggacttacgcaggagcagacggaaaagtatttggataagaattttaacatcggacagatgagagtgttatcggaaggtctgcataaggggattccggaggaactttttaatatccttcacaataataagctctccggcaatcagatgaaggtatcactggaattttatgaaaagggagttccggttgaaaccatacaggaagctgtggcaaggggagagaagcccgttgtgatgagaagattatatgaagaagttctggcacagctttcaaaggctgcggagcagtatacgcaggactcagagtatgtgaaagaactgattgcacagatggaaatggtagtggagaaaatcaactatcaggaggaaagatacgatgcccttaataaaaaattatccgatgttgaagtattaaaggaagataaggaagtcacggaaaggcttgtaaaggaaaatgaggacaaggatggaattatcagccatcagcaggatgaacttaataaggcaagcagcacgattgcaagattaagagatagcattgagcataaggacaaggagatggagcgtatgagagacaggatagaatctcttgaggataagattatgagtgcggcatctgatgatcagaaggttgcggaaaaagaggaaaaggctggaccgtcagaggttttggcagctactgataataaggaaacagtgaaaacacttgcagattcacaggcagtgccacctatgtacaatggaatacccgtgtattatcagatacctgttacggactctgccgggcgtgtaatccagcatcttccagttgagcgtacagaaagaaaatcaaatggtggtattgcggcactttttgccagactttcatttaaaaagaagtcaagagccgacattgtaaagctggttgcaagcggtgatcttgtgcctgcacagcttgtccagataaaaagtgccatagaaaagggactgacagaagggcagcttgtggaacttatcaataataatgtctcagcagaaaagatgaaagagattattgagattgccgtgcttgaaaacagtatggcaggttaggaggtacttatgaatttagcagtagtcaatgaggcggtaacagggatgaacggtgtagaacacgagttcacggaagaagaaaaaaactttgtggtgcagtttgctttccgaagcggcagtaaggaagatacgatttccctgatcgaagctctggcacattccacggataaggtacagtccgaggagattatggtcacatacaggtcaaagtacgatataaagcctgcgtgggtggaacaggtcgaaaacctgcttgtggcacttgagatgtaccggatagaggaggaaaaagcaatcagtcatctgtctgatattttaacagcatatggtattgatgtttcagcagaggaaatccgcagtacaaaggcggaagaaataaggacaacaataagagagaaagcggaggtgcgataatggcagaggaaattcaggaagcggtacagattatccgtgtcgcatatgacgggatagagattgctatgaaagtaggcagtggcggtattgccgccatgcagaaggcaatcgactttttaaaggggatgcttgattatgaaaagtcgttgggaaaaacatctatgagaaagctgctcttaaagggcggggatttgcaggtattgcagtttaaaacggaagatatgagaaaggttgagagaatggcaaagaaatacggaatcctgtattcggttcttccagactgtaacaagacagacggtatgagtgaggtcatctttcatacagaggcagttccccgtgtgaatatgatgatacagaagctgaaatttggcaggattgccacctttgatgactatctgaagaatggagatgaaaagtccctcggcaagctgatggattttttgagaaaacagcagggaaacgagaaaagccacacggtagaaggggataaggtaaattctgccatagacggactcattgaaaaagtgggaatgtttgctatggaaaaacaggctatcagtgtggagcaggtcaaggagaatttcagcatcaatggggagcaggcagaaaatgtaataaaacagcttgagacaatcggggtgcttggcggcaggagtgaggatggtacacacaaggtaatgatggataaggaggctttcactaaccggatcagagggtatcagagccttgcggacagaatgagggcaatatctgcctcaaaaaatacgaacctgtcagatgttacgatcagtaagaaacttattgcagaagaaaacgaccatgcagtaaagaccagagttccgggaacatggggaaaagatgtcagatatgtgtggctgcataaggagaacgttatggatatccataatggaaagacaatgctcacattccttgataccagcaaggattacaaactctatgatgagcagaaccgtgtggtaactacgaaaaagggagacgaactttatacgcattatgataaggtagaatcatctgtcagggagcgatatgaaaaggttcagaaagaacagaaaaagaccacaaagaagaaaacggttactaccagaaaagagaggtaggagcctatgcagacaacgaagaaaaaaccgtcactgatatttattttagtgggtgcagtgttatccgggtatcttggttatctgataaatggtgcatggacagaagggattgcctttaatgactttatgaacaggttcaatgaagtgtgtgcagttccttttgccaattattacaattcaaatacagtaaacgcagtagccattgcattatgtatctatgcaatggctattattatgtattacaccagccagagaaactatatgcccggcaaagaatatggtacagcaagatttgaaaatccgaagcaggtcaataagatactggcggataaagatgagaatttcaaccggatactcagtcagaatgtgaagatgtcgctggatttccgaaggctgaagctcaacggaaatatacttatctgcggcggttccggagcaggaaagacattttatgaagtaaaaccgaatcttatgcagatgccacatagctgttcgtttatctgtactgatccgaaaggagagatattaagaagctgcgggcagatgttaaaggataacgggtacaatgtaaaagtcatcaatcttttggagatggataaatcagactgttacaatccattttcctatatcagagaggaaactgatgtggtgaagctgattaccaatcttatcagtaataccacaccaaaaggctcaacgccgagtgatccgttctgggagaaagcagaaggcttgtttttacaggcaattttctattatgtgtggctggaggtgcagcctgcaaagcgaaactttgagacagttttgaagctgcttggagaagcagaggttaaggaaccgggaaaggcttcaaagctggatgtccgtatgaagtttctggaggagagttcgccgcttggagcaaatcaccctgcggtcaaacagtacaacaaatgtatgagaggtgcgggcgatacagttcgttctattattatcagtgcaaactcaagacttgcatttcttgaaaataagcaggttttacgactgctctccaaagatgagttaaatttgtctgatatcggtattggagtaaatggagatggggagacaaagacagcactgttttgtgtaatcccggatagtgataaatcctataacttcattatcggtatgttatacacacagatatttcaggaattgtactatcaggcagactttaactgtggtggcagactgccgatccatgtaacctttatgttagacgaatttgcgaatgtcgcattgccagatgacttctgttcgttgttatcgacaatgcgaagcagggagatttcaagtattatcatcattcagaatttcgcccagctaaaggcacttttcaaagatacttgggaaacaatccccggcaactgcgatactttcatctatcttggaggcaatgagcagagtacacacaagtatgtctcggagcttttgggcaaggggacaattgataaaaaatcaagcggtgagacaaagggcagacagggaagctcatcaagaaattatgatgttttaggcagggaactgtttacacccgatgaggtcagaaagctggataataagaaatgtattatttttatccgtggttttgatcccataatggacaataagtatattccattccgacacccgatgtttaatcagacagcggacggaaaaggaaaagcgtatgttcataatacacagggagcagaccgtatcatcggaccaccatttgagattttatcggaaaaagccgttaagcattatgaaaaaatgaaggataagggagagaatgtgtatattgatacactgacctatgagcagtttatgatgcttggagatgcggaactgaacagaagattttcaatgcaggatgaggcagagcaaaaagcaaaaattgacagggagcaggcaaatgagcttgaatatgccgatgaatcgcagaaagaggaggactcagacaacagtggaggagaacagccggtaagaaatcctgagagggagaagccgaagtgggaggatacgatcacaaaccgaatgatgcactggtcatacaccgcagagcagaaagaggaagtgaagaaagcacttgcggcaggtgttccgaaagcaacgattcttacttatttctatccggaagtgacggtggagaagatgagttcatatcggaagaatcagtaaaggcgtcgcataggcacaggaactgtggtataatgtgcctatgcggaatgaaagagtttcgtaaattgggaattgtatggtggtactttaatggaaaagaaagattttttgtatacagtgattctaacaacaacagtatttgcagctcttataacatcgatagcgaatataataatttctttgataaatagttatagattaaaacatattgaagaacaaaaaaagttaaatgaaattgataaatatcgatatagcaggttgcatgaaatactaataaattggcataaatatgattctgaaatcaaaggagaaacagacagtgaaatagcattttatagattgcttaatcaatttatggacgatttggggcgttatgaaattgcaaaaccgttactcgatgcgggctatactgaagaattggaaaacaaaaaaatagaatgtgaaaatttactaaataatttagttgaagctgaggcaccagatggtacacatacaaaggattttccaatcataagagaaaaatattttgcaagtggacaagagttctcgaaattattaaaaaatgccattaatagtcaacttgaatcattattaagaaaaagcaatatatgataattatagctttgtcattcttgtaaatgacttaatatttaattcacacagcactttagccaattatggttaaggtgctttttttgtaccttgaaaggaggtggtcacagcaaaacatatcggggaaagcccgattttatcattacaacaggctatgcctgatcatataaagtaacttttaacagccagttagggataaaccctgctggctatttttttatcgaaaaggagacaaccaatatgagaaaagaacagattattacgacaaccaacaacaatcagatggaggaaaaaggtatgaagcagagatttattcagtttaagaaaaaatttgttccggcattatccggagccgttatgggagtaatgcttatgagcactacctgctttgcggcaggaggtacttcggcagtaacacagccgcttgagaacttaaaaacgcttgtgatcgcagttatcggtgcagttggagtaattatccttgcaaagaatgtaatggaatttgcacaggcataccagcagcaggattcatctactatgaactcagctttaaagggggttgtggcaggtattatcatggcaggtatttctactgtactcactttcttaggcttctaagatagggaaaaaataatccctgttgcaatagaagaaaagaggtgaataacaggtatggatatttttaagctgggagacaaaatacttgctctccttgaagctatgtttggattttggaacaatcagatatctttggtttttgcaatgcttggacaatcgcccgtcagttttaagggcggtggtccgtgggcagtcatcgagggaatagagccaatctttgtagcggttggttcttcccttgtggtactgttctttgttatcggtttctgttcggaaagtatagatgtgaaagatgaaatgaggtttgaatcaatcctgcgtatgcttatccgattaggacttgcagaatggtttgttgccaataatgtcacgattatgaaagcattttttacttccatcggaaatctggtagggcttatttcggcaggaacaacaacacagcttgccattgacagtgcacaggcagatgttattaagggacttggatttggtgaaagtctggtaatgctgatccttacggcactgcttgcaatcatcattattatctgtggtttctttatcatttacaccgtgtatttcagattcttaaaaatattgatcattgtgccgcttggagcaatcgcctgctctacaatggcaggaaacagaatggtaagtcatacgatgtcaacttactgtaagtatttcttatcctgtgtgtttgaggcggtaacaatggcacttgcgattgtggtatgcaatgcatttatcaatgcagggctgccttcctttacgggaagttatgcagactgggcacagacacttatttatctgtgtgaaatgacatttaccatagcaatgacggttggaagtgtgaagggagcacagacacttacaagtaaggcattcggattatagaaggaggcatttatggataatgaaaagaaacaggtgacttataattccagtttttccggggagacacaggtaacactcgatattcagcagtatatgaataacaaggcaatgtatatcgggcttatgtgtaatgaagatggatacgatgagccgtttggtgatgtgaccgtaaatttgtctgttgctgcaccgaattactgcggatatctgaatgtgaatgatatgccggatattgagaaattcatcacagaaaatgagcttggggagtttacaggatttacacagaggagtggttattgtgaatatcctctttatctgttcaatgtcgataagctgagagaactgtgtccggatggaatggatatgtatgaggcaaatatcggtatggcaagaaagccggagacaaaggagttagcaagatagggggcagaggacaatggttattgaaataaacaaagatattgaccgttatcaggaatcggtggcaatgggacttacagcaaaacagcttgtattttctattgccagtgtgatagtcggtggcggtatcgtattacttctttatagatatattggtcttacgggttctgcttatgtggcgattccgtgtgtagctccgatagcacttggaggattttattcttttaatggaatgaatttctacgagtatatgggaaagaaactgcattttatgtttggaaataaggctcttacctatgtatctactgagggagagccgattatcaaggcttttgaaatggagcagaacggacaggtaaagaagaaaggtaaaaaaactcaatcagagattacaacatctgagtcagcagtaaagaaacaggaggaatttgaagaaatgaagaaaaagacaagaaacatgatgtttggactggcagccgtgtttgtgctggcggtagcgggtgtggctgcttataaagcaatgcactaaaaaggaacctgcataaaaacagattccttaaatgagggaaaatccctgtcgaagaatggaagtccagttacttttctgatagagaaatcggactataattacagtctgcttttcttcatcaatcgtataaaaggcaaggtaattattgattatcacaaaacgaatgccccagcttgccagtaccggatcatctaccagacggaacttctgtggcaggtcggctaatgagcctatctgctcagtcgcagcatctaacagattatctgcggcatcaggatttttgagggtaaattcgatgtaatccgcagcacgcataatatcgtgttctgcggtggaagtgatatgaacctgatggctcatcggctgcgtcggctcctgatatcagccatagcttcggaaaatggtctggtgttgcctgtggcaatatcgtccattccttccttgatctggctgtaaagttcaaagcggctggtcagttcttcgtaggcttcaatgctcataacggcaaggtcgccttttccattcttcgtgatgaaaactggttcaggataattatgacaaaatgtagaaatttcattgtaattattccttaaatcagcacttgatttgattgctggcataaaaacacctccttgtttgataacgaaattatacacaaattttgttatgaagtcaatggatataccattagtgttagcaggataaacacaactattcatatgtatctgaccgtgaggtcgggaacaagcccgttgggtgatgttcccggcgggctttcacagataagaaagcgaggttagagacaatgggtttatttacggacggatttaagctcttgaaaaaggcaagtgagcctttgtataagacaccgaaatccattcaggaaaccatagagattatggcggtggctgaaaacggtatttttgaagtaagcaggaataagtattccaagtgttaccgctttcaggacatcaattacacaacggcaacggaggatgagcagatcggcatttttgaaagatactgcaaattcttaaattcgctggactgtaattataagattacgattaacaataagaacaaaaatatggaggatctccgtgataaggttcttattacagaaaaaaacgatggcttcaataattaccgaagaatttacaatgacattattgaggagaagattattgagggcagacaggggattgaacaggaaagatacctgacgatcacgattgagagaaagaactttgaggaggcaaaggcacagtttgccacacttgaggcaacaatacacaaggctttcattgaactgggggcggagattgtgccgcttaacggcaatgaaaggctgaaagtgctctatgactattaccatcttggcgatgagggcagttttgattttgatatcaaaaaggcaaagaaggtcggagcagattttaagaatgatttatgtaatggtatggtgaaatatttcccagaccattttgaggacgagagtaaatactgcaaggcacttttcattaagaagtatcccagcagtttatctgacagatttatcaatgagattacttcccttcctgtccactccattaccagtattgatgtagtgcctgtgccaaaggatttgaccacaaaggtgcttcagaagaaatatcttggtattgagtcggatattatcaagcagcagagagtccgtaataagaacaatgacttctccacagaaatctcttatgcaaagagaacggagaaaaaagagattgaggcaattatggatgatgtccgtgagaatgaccagtgtcttttctttgtaggagttaccattatccttatggcagaaagtaagaaggagcttgagagtgtctgcgaaacagtagaaacaatcggaaagcgtaacagttgtacgattgatacacactacttaaagcagagggaagcactcaacacggcacttccgattggtgtaagacaggtggaaacaatgcgtacccttcttacccagtcgcttgcggtgcttatgccgtttaatgtgcaggaactgaatgacagcacaggtaattattacggtatcaaccagatcagtaagaatgtaaatatcggtaacagaaagaagctcatcaacggaaatggctttgtattcggagtgccgggttccggcaaatcattcttctgtaagatggaaatgggcagcgtattcttgtcgggagatgatgagattatcgtcattgatccgatgaacgaatattttgatattgcacagacttatggtggaaccgtggtaaatatgtccatatacacggacaattatgtaaatccgcttgagatggatgtgtggagtcttgatccgaatgattcaaagggaatgataagggaaaaaggggaatttatgcttggtctttgtgagcagtgtatcggggacagcttaaattccagacagaaatcaatcattgaccgctgcgtgagaaagatgtatatcgacattgcaaggggcagggaaaagtatattccggtaatgagtgacttctacgatatccttatggaacagccggaggacgaagcaaaggatatcgcattgtctttggaactttttgtaaatggttccctcaatatctttaaccaccagacaaatgttgatgtagataaccgattcacggtatatggtatcagggacttaggcacggagcttagtcctatcacaatgcttgttatgatggagtctattcaaaacagaattgtagaaaacgggcagaagggcaaggcaacctggctctatattgatgagttccatgtcctgcttaattcggagtattctgcaaaatatttacagcagctctggaagaaggtgaggaaacaaggtggactgtgcacgggtatcacccagaacgtcgtggaccttttacagaactacaccgccactacaatgcttgcaaactctgagtttgttgcactcttaaagcaggcgaatacagacagttccaagatggcagaggttatcggtgtatcagaggcacagcttcgtttcgtaaccaatactgcatcgggaatgggacttatcaagtgtggttccgtggtaattccgtttgataaccagatcagcaaggacactgacctttacagactgtataacaccaatatccacgaaaagattgcggagcagaagaaaagggaggcaaaatttgctgattagaattgcaatgtatcagccatttggactaagttccggatggctacttttttaccttttttaaggatacagaaagaaggtgggaacattgaagataaaaaaagtggatgacaagcctatggtcattcacactaagaaaaaagctaagattcatatgcatgaaccgaagaaggctaaaattaagggcagtaacatttacaccgtacagcgtggtccgaaaattgccagtgcaaagataaatgatacaggtaaaaagaagtcttatcgtaagagtaccattcatcaggcagagaagaaagaaaaggaaccttcaaaatttaagagaaatatacgggagtccaatacttctatcaagacgaagaataccaatcttcatatagcaggaagaacgggagcacttgcggctggagcagttacagagcaggtggaaggcgggcaggaagtgtcacaggcagcttatcttgcatatgaagtaagccgtccggttacgggaactgcttcaaggggagcgtcacttttcagaaagaaagcggcagccgaagcaaagaggcgtatcaagaaggtagaaacaggaaagaaactggcaaaaaagatgggaaagaaagctgccagtgatacggcaaaaaaggttgccggtgacacgacaaagacagcagcgaaagaaactgctaagaacactgcaaaagaaactgccaaaactacggcaaaagcggcaaccacagcggcaggtacagcggttgcaccgggagcaggtacagcagtcggcatggcggcaggctatgccacaggtgtatctattgaggcgaaggatgtgaaagcagcgaaccgtagcagaaagattaaattttttctggataagatgaaagaacaggaaaatcagacggacagtgttgtaaaactggtaaaagatctgattgtaaaaaaggcagttctctggataaaggcggcagctccgattatcggacttgtacttttgctgttggttcttttagtggtaatcgttgcagttccggttattgctgtgatagcgattctttataattcaccatttgccttatttttaccgccgctggagtcaggagatacagtgcagacagttacaagtgcttatgtgtctgaatttaaccgtgatgtgaataccaaagtgaatgaacataccggatatgactttggcgaactggtgtatgtagattatgagggaatggatgaaaatccaagtaactactacgacattatggcggtctacatggtcaagtatggtgtaggcgatactgcaacaattatgaatgatatatcaaaggggtggttgcagactgtagtaaatgatatgtgttcttatactacaagtagtggaacaaaagatgtggaggaaacagacgcagatggcaatgtaacaactgttacgaagtcggtactgtatgtaaatgttacgctcaaatcatacagagatatgatttctgtttatggatttaattctgatcaggtagaaatgcttgagcagatcatgagtccggagtttatgggacagcttggatatgccggaagtggaagcggtggaggcggtggaagccccggagtaagttccatgacagaggatgaaataaatgcaatcctcagtggtattacagatagcaggcagaaagcagtctgctcttatgcccttcacagagtgggttatccttacagtcaggaattaagagatagtggcaattattatgattgcagttcacttgcgtattattcatggaaggatgcagatgtgaatatcagttatggaggagcaactacagcagcggcagaagcacagggacttgatgaagcaggaaagaccgtatcttatgatgaaatgcagcctggtgatcttatcttttacagtttcacaaacaacggaagatataagaatatcagccatgtggcagtatatgtcggcaatggcaaggtggtagaagccctgaatgaaagagttggcgtagtttaccgtgatgtggcaagtgttggaaagattgtagtaattggcagaccatagaaaattggcagagagggcgaaagtcctctctgggacaggaggtaagaatggatttaaaggatatgattcttgtaatggagaattataagggaacagaaagaaatatgcttatgactttggaagattataagaagttcgttgccattgatgatatgtcagagcttgcagatcagatgctgcttcttggaagaacgcttgcggaaggttttacagagtattacagggcagcaaatgttacagtttttgcaaaattctgtagagatgatgtggaactgggacgctttttgcaaggatattataatgattcaaagaaattttactttgataaggcaacaagttccccagagtgtattacaaagatggatgagattggaatgacggatagaggctggatagatgactttatcctgcattatgaaaaatgcgacaggacatttgaaagagggcagacatttcataattttaatgaccacgattatatggtacttgaagcattatctccacgcaatcttgtggtaatggatatgaaaagcggctctctcacgattgctcttggagcaacagagtataagcgatatccgaaagacgaggagccaactaaggataacacagcgattggggtatcgtgggagcacgggatttatcttggttccacactttcgcagaccaactttaaggcatataaaagagaatacgggacacctgaaaagataaaagatgtttatgattacagggcgaaactcaagcagaagttttatttttatcaggatttgtcaaaggatgatgatattccaaaaaatatgcagaatgatttcctgcaccagatgtataaggaatttggaacgatagaggaggaatatttttatgacaggcttgaagatggaaagtatgatgaaggttttaaggaaagacaggtaaaagaaaaaaagagccgatgaggaaaaatggaattggaggctgatatcgaatggaaaaagaatttgatattgagataaaagaagttctctcaagggtagagacagtaaaggcagagtcacttgacgatgccataaacaaggcaatggatatgtattattcagaacagatagtccttgatgcggaggatatgaagggagttgatttttcgccatacagcgaagaacagctcccttcttcattaaaggaaaatggaggaaagacacgatgaaaaatgagcagacagcagttattaaggatatggaatttttattaaacgaacttcataaggaatgggaaagaccgggagaggtaaaatcgtctgtcagtattccatatgagaaagttgaggaaatcagcagaaagctgaatgtgattgtctatgagacacagcagtcggctgacagcgacggacttgcctttaagcagagcatagccaagtcaaagcagtgttatgtgcttctcaggattatgcgaaagattgtaaaaggaaagggcaaatgtgatggacaggcggttgatgcagaatttgtgattgagcttgacggggaggagtcaaagctctttaaggaaatgtttgcagaattactgaagtaaaaggagggtgacacatgagtgttgatatgaaggtcaaagcgatatatgattcagaaatcagcaacatcacccgttctgaaaagaactggaaagatgtattaaaagttgctggtcagttatatcgctatgaatttgataatatcgttatggtaacagctcagagatcaccggagaaaagtacccttatggcagattatgacacttggaagaaagtgggaagatatgtaaagcgtggagcaaagggctgtgctatcttcccctcaagggcacttaatccccgtatgagatatattttcgatatcagtgatacaggcggaaagaatgtgaagctgacttgggatctggagggggaaaacctgaaaagttatgcagactttctggtatcggaaggacagatggagcggtataaaagcgatgacagggaatcactaaaaaatacgctaaaacagtttacaggaacaaatgtttggaatataataaaagaggagttcggggatagaatgtccgaactaatgcagctatcaggtagtgtgataaaggaattcaacgaaaaacgcaagggcttacagcaggatagcgatatggagcagttagtatattccagtgttatgtatgctgtagggacgagatgtggatttgacttatctgtgcaagaacaggatttcagtcagattgtaaatatcaaagatgaggagatagtttaccgtcttggttcccttgtatgcgatgtctcctgtagtgttcttagagaatttagtaggaatttacaaacgattgagagcgaaaggagaatatcatatgttagaagcaatgacttacaaggaagtggacggactgctgtatccggagctgacaatgccggacgagacagaggatttaacgaagctgggcagatacgggagaatggcaatgaagtatcttctggagaacgaaccggcaaggtacaagacactgatgagattcgggaagatgtacgagaagatgtcggcagtagaggaggaagcaaaccagctttacgatcagttggaggaacagtatctaatgaagcacaagccacagaatccgtcatcgacaatggagatgtggaagataagagagcaggcgaagatgcaggcagaggaagtagtgctccaccagatcgtgatgaagtttcattagaaacacaggaagaattaaatagagagcttgatgagattaactcattgggtgtcagtaaggaagccgaatatacacaggcttccttttttttcgaccaaaacgggcaggcaagttttggtgtgaagcagccggagaaaaccagacacaatgaatttatgcgtcagttcgaggaggataaaaaggctgcccttgccagaaaatataattaccttaatccaaagaaagcagagagtgtaccaagtgagtatgtaaaagagatacttatgaaaggaactggctttgtcggtggaaaaggcagggtgtgtgaaatctatcagacagagatagacgcaggaaccagagcaaagcgtatcaaggcagaatatggtcaggggggtgcaagctggccgcttgacggtctaggcttgcacgggtatgacacatttcacggttcgggacttcgtatccaatggaaagatgaagatggagaagtagaaggatacgtttcgtggaagaatgtcgaaaaggaaatcggtgtacttatccttaccggagaataccagtcggagacacctcgtattgatgagcttgcaatggacggacttcgtgaagatgatgaagtcattgacgcagagtaccgtgaagttgatacgcaggaggagaaatcagaaattgatgattatgctattcctgatgagcctgacagttatgctgtaaacagaaaggcggctgagttacggtatatcaagccgattgattatgctgaccgtgtagctgcaatggataaagatttaagagatgccattgagatacttgtgtcagaatgtagctgttacacaccattccgtgctttccttatggatgtggtgcaatcggattttgcatttatgccgaataagctggaactgatctgtgagatagcgatgggaaatgttcagggtgagagaaaggcatattgcaataatcagtatggactcacagaatacactttaagcagtgcagatgtgaaagtaagctacaaaaacagaaatggagagagggcaggggataccgtatcatggcgtgaggtatatgaaatcttatcctatatggtaaaacagccattgtactgtggagaggaccagaaggcaatctatcagaccataaaaaataagattgacagggaaaagatgaatcctgtttatcgcaagttctttgatattgaggacagtgtgagagaaagccgtcttaaaaccagagaacgggcgattgcatatggcttgaataccaagattgacacggatggtcgtataatttctgatgaggataagaatgtatcggcagatattccacagaaggataccgaaccacaggaggctgcccctgaaacacctgcacaggaagtattaccgccagtggaaggtctgcgtggaaaagaaaaaacacaagaccagacaaaactcaatttccactataacctgtgggaaacagaaaagggcggtgcaaagaccagataccagtggaacattgacgcaatccgtacactaaagcagattgaagcagaaaacagacttgccagaccaaaggagcagacagttttatcaaagtttgtcggctggggtggcttgtcacaggcatttgatgagaataatgctgcgtggagcaaagagtatgcagaactgaaagagcttctttccgatgaggaatacagtgcggcaagagcaactgtaaataatgccttttacacttcgccggagattgcaacgtgtatcaattcagcccttgtgcagtttgggtttaaaggcggaaatgtcttggagccgtctatgggtatcggtaatttcttcggaagtatgccagcaccaatgcagcaaagcaggctgtacggagtggagctggacagcatatcgggaagaatagcaaaacagctttaccagaatgccaatatcagtattacaggatttgaaaacaccacatatccggataacttctttgatgttgttatgggaaatgtgccatttggagattataagatattcgatccaaagtacaacaagtataacttccgtattcacgattattttctggcaaaagcactcgatcaggcaagaccgggaggtatggttgcagtgattaccacaaagggaacactggataagagcaatccgactatacgaaagtatctggctgagagggcagaacttgtgggagcaatccgacttccgaatactgcatttaaggataatgcaggaactgaggtgactgcggacattctttttttacagaaaagagagcgaaaaattgatatagagcctgactgggtacatcttggtgtcacaggtgatggcatagcagtcaattcctattttgcagagcacccggagatgatgcttggtacaatgcagtatgatacaaggatgttcggacaggacagcaaatataccgtctgtgtgaataatgatgagaacttcaatctgtatgaagcactcaatatggcaatcagtaacatcaaagcacagatgacagattttgagagactggcagagaatgaggaacagacagaggaagtcattcccgctgatccggatgtcagaaattatacttacacattctttgaaggaaaactttactacagggaaaattcagagatggtaaggcagaaagtatcaccgacagcggaggggcgtattaagagccttgatgaaatcagacagataacaagagagctgattgatatccagatggagggctgtagtgatgaggagcttgcagacaaacagcagcttttgaatgtaaaatatgataaattcgttggaaagtatggagcaatcacttccaaagcaaaccgtacagcgttcagggatgacagcgattatccgcttctttgcagtcttgaagaagtaaatgaggacggggaggtgaagaaggctgatatgttttataagcagacgattaaagcaaagtccgtggtggacagggtagaaactgcagttgaggctcttaatgtatcggtcaatgagtttggatatgtaaatattccttatatgctctccatttatgaaacagacagggatactctcataaaggaactcgatggaattatttttcttaatcctgaccgttacaatgaaaataacccggacgcaggctgggagacagcagatgaatatctgtcaggcaatgtaagggataagctgcgtgttgcaaaggcaatggcggcggataccgataatccgcaggcagaaagatttgccgccaatgccgcagccttagagaaagttcagccggaatggattgaagcctcggatatagatgtaaagattggtacaacttggattgaaccgcttgattatgaacagtttatctatgagctgcttaatacaccaaaaagggcaagggcaatcagaacggagtattataattccggtattcaggtacacttgaataaaatgagtatggaatggttcattgagaacaaaagtatggataaacattccgtggcggcaacgaaaacttatggtacaagcagaatggacgcttattctatttttgaggataccctgaacttaaaaacggtcactgtcagggacaggattgatgatggtgagggcaagtaccattatgaagtcaacaaaaatgagacaatgcttgcaagggaaaagcaaaatatgatcaaggagaagttcaaggaatggttatttgcagaaccggaacgccgacagaagtatgtggaatattataatgaaaccttcaataatatccgcctgcgtgagtatgacggaagccatttgcaatttccgggaatgaaccctgagattgaattaaaaccgcaccagaaaaatgcggtggcacgaatccttatgggaggaaatactctgcttgcccactgcgtcggagccggaaagtcgtttgaaatgatggctgcgtgtatggaacagaaaaggctcggactttccaataagacaattatggtagtgccaaagccgcttatcgggcagacagcaagtgaatttttaaggctttacccgtcagcaaacatcttggttgcaacggagcgtgattttgaaaagagccgaagaaagcagtttgtatcaaggattgcgacaggcgattatgactgcatcattatgtcgcactcgcaatttgagaaaattccaatttcggcagagagaaaggagcgaatgcttaatgaacagataaatgagatcacctatgcgattgatgatatgaaggagcggaacggggaacgctggaccgtaaagcagatggaaagccagaagaaaaagctggaggaacagcttaaatccctgaccgatgagagcaggaaagatgacctcattacctttgaggagctgggtgttgactctattatggtagacgaagcacacaattttaagaaccttgccattttttcaaagatgaataatgtgtcgggaatcagcagtagtggggctaagaagtcaacggatatgcagcttaaatgccagtatttatcagagataaatgatggcaggggcattgtatttgctaccggaacaccgataagcaacacgatgtgtgagatgtatgttatgcagctttatttgcagaaatcggcacttgaggagatgggaattcatcatttcgactcgtgggcggctaactttggagaagtaacaacggcactggagcttacggttgagggcagtggtttccgtttcaagagcaggttcaataagtttaccaatctgccggagcttatgaacatcttccgtgaggttgccgatgtgcagacagcggatatgcttgaccttgatgtgccagctctgcgtggcggcaagcctatcatcgtggagtcggagccggactggtatgtgaagcaggtaatggaagaatttgttgtaagagcagaaaggataaggggcgggggtgttgatccaagtgttgacaacttcttaaagattacgcacgaagcaagacttcttggaacagacgcaagactgattgataaggacgcaccgaacaacccggacggaaagctcaataaggtagcggaaaatgtctggaaagaatatgtaaaaggaaatgctgatggtcatataggctgtcagcttattttttcagatattggaacaccgggaccggacaaggactttacgatttatgattatctgaaggagtcacttatcaagtatggtatccctgcggaggagatagcatttattcacgatgcaaaaacagacgcacagagggatgcactctttaaggaaatgaggacaggtaagaaaaaagtccttatcggttcgacagataagtgcggaaccggagttaatgtacagacacaccttgttgcaatgcaccatgtcgattgcccgtggaagccttcttctattgaacagagggaaggcagaggtatccgacagggaaataaaaacgatgaggtggcaatctaccgatatgttacaaaacaaacctttgatgcatacaactggtcacttgtggaaaacaagcagcgtttcatcagtcaggttatgacaagcaaggcagtgagccgaagctgtgaggacattgatgaggcaacactttcttatgcggagattaaggcggttgctacaggcaaccctttaatcagggaaaagatggaggttgacaatgatgtccagagattaaagctcttaaaggcgtcttatgataatcagagatacggattgcaggataattttatgatcaagtatccaaaactcatcaaaactgcgacagagaaacttgccaatgtcagggaggatataaaggcaagggataaggaattgattgataacccggattttgccattaccataggcaatgcaacttatacagagcgagtggatggtggaaccgtaatgcttgaagcaatcagcaaatgtaagacaggcgaaaccactccagtcggtaagtttcacggctttgagcttctggtggaaaagaatttcctcagtatcaactatatggtgcttcgtggaaagacggaatacaaggcagaactttccacaagtccggtgggaagtatggtaaagctggagaacctgttcaacggacttcacgaaaatgttgattttctggaaaagaagattgaacagtaccaaaatgatcttgaggcttcaaaggcggagtatgacaagccgtttgcatatagtgcagaactggaagaaaaacttgcaaggcagtatgaattaaatgcccagcttgaccttgagaatgcaaaagctatggacgcagatcttggcggactggacgaagaaaagtctgaggacagaatagaaaatgcgggtattgttgcagaggataagggaatctatatgccagacagaaacaggaaaagataggagtgaaactctatgagtataaggaaagtggtcgcaggactactgattacagcagggattgccattatggcagtcccttttttctggtgtacaaccggagagagaaacacgaaccagctcataaatgaatttgagcagacattggaggagaagcaggatgaaaggacagaggttgagaaagagcaaaccaccgttagtaaagaggagaaagccattcttaaagaaggcagtatcatcggcattattgagataccgggaatagatatcagatacccagtaatggaagaaaccggaagtgaaatgctgaatgccgggacagggaacaatgcgttttgttgtcaggtgcagatataaggaggcggcagatgaataagagataccgactgggggagatagaagaagctgtatcggaaatggaggagctgatcgacactcaggacgatattgcagagattgatgatgactttcagatagtcgtaagcggctggtctgtgtatgtcgaaagcctgaatctgacactcagacagggaatagcctgtgtatgggatgcagaggaaggattatttatgcctgattttgatgtgactatcgtgtatgaggggaacattgaaacacaggagtggctctactacgagcaggacggaatggtcgttacacttggcaactggttaaatggcagattgtcttgtgaacagatagaacagctttggtgtgagcttatcataccggagcaaaacaaagaacaaaaagaaagcgaggaatagtatatgaagtattcaattaaggtaaacgaagtaagagcaaaagagggcagcaatatcaaaggatttgcaacagtggtattcggtgattcatttaagattaccaatattgcaatccttgagaataaggacaagggagaacttttcgtatcaatgcctagataccgctccaatgagcgtgatgaaagcaatggtgtgatctataaggatgtgtgcaatcctatcacagcagagtttcgtgaggaactctataccaatatccttgatgcttatgcaagaatcaaggaaccggagaaagaggagacacagaagcaggacagaacacaggaaatgcctgagttttccgtaactgtgacaccttatgagagggaaggcagtaacatcaagggacttgcccgtatttactttgaaaacagtttcattgtaaataacatcaatatcgtgcagggcaaagagaaaatctttgtatcaatgccatcttataagacaaagcaggtggatgagcagggaaaaccaatctaccaggatgtctgctatccggtcacaaaggatttcagggaaaaactctataatgagattatctcggaatatgagaaagcaaaggataagagcaacgaaaaagcaagggagaatgccgaacagaaccacggaaatcccgacagggagaaaaaggatactccctttcgataattaaggttaaggggcggcaggagctgccccgtttataaggaggaaaagcagatggaagcagaaaagacacttaccaatgaggagatcataagggaacttcttgacctattaaaaaagaatgctatgaaagagccggcaaatgatgtatttgagatatgcacctatgtggatggtctggagaaaaagattgcgtctatgacagaagaacttaccagtatgcaggaccaaatcaagaaaatgcaggaagatacccttatcaataatgcaaaaaaagcattaacagaagcacaggagcgactcaatgccagatgtgagcagataaagtcacaggtatctgagataaaggtacaggtaaaatctactgccaagaatattgttgatgaaacaaaggcaaagggcagggcggcactttacagggtgacagaatttgtaggaattaagaaaagacttctcaatgtcagaacagtggtaaaagatacgattgtatctacagacagggatattgcaaggacagcacttcttgcaaagggattccgtgaagctggtcagaccgtaaacaatgcgttccgtacctttgcagataaaccggagatggattattcacagaaggaacagaaacaccctctcacaaaggcggcacttgcccctatgaaagcagtgagaaaattgcttgtatcaatggagctgcatctggatgcttcgattgataagctggataatctggctatgaatgtgcagcttgataaggaaaagcgtatggagcagacaaaggataaggaacagaaagcaccggatacagaaagagagatcatctattcaccgatggtagctgaaccacaggagtacaagtataatgcagatgcttttgaggcaagaaagacatcggaggcaaagcaggaaacggcggggaaggagctgccaaaagtcagagaagataaagccagataagtttaggggcgtgggagtaaaatcctgcgtcctttttatttgttttaatagcaggcaaaaaatggcgaaaatataaaaaaatgcaagaaatggcgagtaatttatcgaggaataagttatcctttgagtaagatagatggactgtggttatgtataaaattttgcaagtaataaattttatacgaaaaaaacacagaaatgggttgcatatatgcaggctgatacatataatctcgacagacagacagacagacagacagacagacagacagacagacagacagacagacagacagacagacagacagaataagtctgttttcttttggcatgatctgattgtatatggcacattttggttatgcgttagtgcataattgaaatgtgccttttatattgaaaccaccttgatgtacggtcatatattgacttgtatatatacatattgatgggacaacaaagaaccattttatccattaggaaggagacaagacaaatgtttaagaaacttaacaaaatgaagattggtgcacgactgaaaaaatctttcagacagattattctcatttttggaatattatcagcactggttgtagtgattatgctttatacgataaacaactatggaacgatactggataattatgcgtatccacagggagacattgctatggcaatgaatgaatcagcggaagtaagggctgcctcaagaggtattgtaggttatgattcagatagtctcattgaaagtatgaaagaacagcatgaacaggctgttaaatcgtttgaggaatatttggaaaaaatacgcccaacaatgataacaaaagagggaactgcctgcatggacgctattgataaagcatgggcagagtataaggaagtggatgcaaaagtaattgaggtcggtgcaacgactgatactgcgaaatcattacaggctcagcagatgatgaccgatgaagcagcaccaaagtatcaggcgttgaatgatgctttacagaaacttatggctttgaatatttcattgggaaatgctgaacgtgcacagttgagaacgattatgatagctgcattgacaattataataattgtaattgcagtatcaacgatttattcaaacagtctttctgttgcaatatcaaagagcattgaaaaaccattaaatgaattaaaggacagatttattacatttgcagagggtgacatagattctccacttccaacggttgagtctgaggatgaaattaaggaacttgtgtctggtgtatctgcaatgtcagacagaatcagagttatcattaaagattctggcagaatgttaaatgaaatgtcagatggtaattttgcgattgatacagagtgtgaggaagtatatacaggagcatttaccggtttgctgacaggcataagaaaaatgaatgaggagattgatacaactgtaagaggggtagatgatgcatcggggcaggttcttacaggttccacaaatcttgcagaagcggcacagtctttagcagaaggcgcaacggatcaggcggcatcggttgaggaaatgcaggcaactatcaatgaacttacaagcggaataaaaacaacagcagaagaattgggaacagcttacgatgaagcctataagtatgcggagattgcagaaggcagtcgtggagatatggaagtattagtgcaggctatgtcacgcataaatgaaacctctgagaagataggagcaattatcacacagattgaagatattgcaagccagacaaatcttctttcattaaatgcttagattgagacagcaagagccggagaagccggaaaaggttttgctgttgttgcggatcagatcagaaaccttgcagaacagagtgcaaaatcagcggtggattcaaaagcacttattgaagcggctattcatgaggttggagatggaaatatgtatgcagagaaagcctcaacttcattgagagaagttgtggatggcatacaggcgattgcagacagtgcgaaaaaataaaagaaatttccattgaacaggcagacagtatggaacaggtagaggtaaccgcagaaagaattgctgaagttgttcagaataattcggctgcggcacaggaaacatcagcgacaagtgaagaacttacagctcaggctactacacttagtggtatggtttcggtatttaaattaagacaataagaatagccgactggaatttagaagagatgtggaagttattttgacattatgagtggaaaaaaactgtgtaggtgtttcggtgaattgttctctgattatatcaaatgcaagaattgtcagttaaggctggaatccttaccttgactgacattccagcatttaatgctcatgtgcggtaaagtaatacacaagaatttcataggtagcagcccactattcctaaatcttttgtggaaaaaaaataaactcaaaatttacagttaattttggatattgtgcataaaaataaagatatttcaagttattggaaattatattcagtatcctgtatttacaaatgtcgatttgtgtggtattataattataaataaaagctgtttgatagtgcggttagtctggatttttgaaaggaggaaaactttatgaaaaagtttttatcagtaattgctacgatgttgacgttaacccttatgatgtcaacagtcgcttttgcagcaaatgacactgatgattcagttgtttacaatgggcggtccttcaaagcaaccgagttatcacaagaaactcttgactggttagaatggtataatggcttatctgatgatttaaaggaaatggtaagtcatgagccattggaattggcatcacctactccatgcacaaccacaacaaccgttgatgccacagctttagatattgacattcctatgccacttgaaacttcgcttcttccaacaagtggatatgagcctgtctataatcctgattattggaataaagatgaaaacattagacgggcaaattgctatgcttacgctatggacgtattaaaaacaacagaaggcaaattacagccaggcgatccatcaggtaagcgttatacgtctttaacaaaaagtgcgattgaaaaagctgttaaagctgatggtccatatttaggtagcggacgtgaaattacaaattcaagtaaaaatgcaactccgggaaagaatcaatacaaagttgccttagttatcgctcctaattctgattatcactggtatgtacaaaatagagatggctattggtcgcataaacaaggttatttaaaagtttctaatgttgatgcaagtggaaagaaaattacagaccctcaatcttgtgaccgaaattatggctcaggactaaattattccacattttgcggatattatttagtaaaatatactaatagatgatgaaaagatatgttagtatatttatagtattgattgttttggtgataggagtgtttttcgtacatcaatcatctacttcccatttatcaatggatattgtcaattctataattaaatcaaaaggtattaacaacgtcacatgggaagattttgaaaaatatacctatcaagatataggaagtgggaattatatttatcaatacgagttaccgaacggcttttatttgtatttaagcggatcagctttagatactccccctacatatatttacatagtagataggaatggaaatcggatcgatttaaagaaatgattttcaatgatggttttagggctaaagagggtattctaaaaccatcatttttaatttgatatgtacgttgttttgaaaagggcgattccaatgtatttataggatttgcttgttaaaaaaactaaattagaaatgaggtacaattatgaaatttaaaaaaattatttctggtatattatctttaacacttatattaggagtttgtagtatatctgcttttgcagcagaaaataccagtgggtgctatgttgtcactgaagaaactcctgaagaaattcttgaatatgcaaaagaggagttccccgaatttctctcccatcatttaagttctaacggaattaatgcgggagaagcacaatatactttgggctatcctattaatattcaagaatctgatggtactaaccgaatttacgattttcctgttatggaaaatggtgaaatttttgcaatgctcaccatctatgacgaaaatggtgaatattacacacagcttgacgaaaatttaatggctgaaaagttaaatgaattacagaatgtaagctctcaaagttctcctattagtctagtttccaataatgctggattttttgcagtagtaaatgattttgtagagccacttacaccggatagtgaaattgaaaataccgtttctttgatgaatgaaagtattactggtaatattgttaatattacaaatgtactttcagaaacagatggaaatagtatttcccttatggaatcaagcaatcctagtccgttaggcgttgtatgcgttcctcaaacagatgacgggacttttaatggtacacagaaagaatggtgcggtgctgcggttactgctgcgattattaactacaaaaagggaacttctttaacagcaaaaggtgttacaaaagaagcgttaggctctgctaaaaatgaaggactaactaattcagaagttatttctgttgcaaaaaatcatgggttatctcccaagtctggaaaccctctaagctattcatcagttaagacagaaatcaatggttatcgcccaatatatatgcaaatgcagcggaaatctgatgaaggaaaaaaataccacgctttaactctaattggatatagttcttcaaaatatactgtattaaatccgtggcaaagtagtagcataacccttaccaaaaaagatagcggtagtgatgtcacctatgtaacaggaacaagaacatataaatggtataccagcatttataactggaaataagatgttgctggggaagtgagaaaaaatcacttcccctaatatctgtttttgcggcaggctatctagcgggcgactatccgccacgttatccatgtgtccgctattaatgatgaattgcttgccgctgtcggctggttagcagccgagtacgggcggatcagcggcaatcttaatcagatagcccggtatctgaacgagtacggcgcaccaaaaatcattgattattcttaaacggacaaatttaaagtgaaataaaatttttattaaaaattcttttgtactaatgtcaaatatgcgttactgttattttttattatggacagcttattttttttaactaagtatctaattctataaataatataataatcatctatacatgccaaataatgttctgaaagattctgaattattttattgattgtcgtaatcttattttcacaaaatacgcctaatataatatcatcaaaaaagttatcatgtattcttacaatgcttccattgatatagcttctcaaattccagttagaattaatatttttattccaactatttatgcattcgtttagttcatatcgtgttaattttttcgcttccttcaataaaccaagcataatttctgcctccacttgtgtccaagaaaaaatattgccatagcctccaacacatacatttatatccatcacataaatattaacattacaatttttaagttcattacaaacacaatataatcccaataaggaagaaggtaagttatccacccatattctgaatgcatttttttcgttcgcaagcctttttatttttttaaatctatttagattatcaatatatgaataatgttcataatatatttcttcaatgaatttcttcctacaattgctatccaaacaacaatttatgggtcctttatcaagatataattgcaaacacaatatatcattcaatgctacatcacttgcctgtcctttttcgttcatatatgtaattattttttctggttctcttttacattgtcgcataatgactcgtaaattagctgcaattccttcatcaaaaacaatctcaatcattttaatctccaatcaaaataatgtctataaaatcccacctatattaattatataggtgggcaaaataatgtgcaaactatactgttattaagttcatgagttttctataatctgacttgttaattcgcaatcacagaatgcaacaatccaattggataacaaaattaagtttttactttataggattagtaagtttcttttctggaattgagtagcttgtgtctccatttaccgaaaaactggatttaacatatacatatggattattcggtgtacttccagcataataatactgtttagcatcacttacagtagtttttctcaaatagcttgcatgagatgctgaaacagcagataaatatgatgaattatttttaggctttacagataaactatgatatgtaaaatagtcgcttttatctattacagttgcggtcatctgtacctcatagtaatgattaactccttttaacccatcatcaaaaaacatatagcctcctacaataacatcctcaaccagcttatatgtttctgtctcaccagatattatggtcatctctccattcttatctattgcaaaataaatggtttcaataggggttctttcatcactaaattcttctgcattttccttaacatatgctgccactgtatctatagccgcattttcttcagatggcattgcataagcgtaattaggaatggtagttattccaagcatcatggctaatgataaaatagctattattttcttaattttcttcatataattgtaattctccttccactaatgaacaaatttcaatatatatgcacattatttggaaaataatagcatacagaaatataaatttacactctctatgcacgaaatacgcatttattgcacgaagtataattcttttgattttatcgagcaggaaactaagattttttatattaagaaaaacgttatgctttaatgtctttaatgcatctttatgcttttcgtgcaaaaaaatcttacttcgtgcagaaaaggtgaaatattataagatgcttgtcgatataaaagaaaaataaaaaggtttttatatgaaaaagcttaatgatatagctatgaaattacttgcaaaaaagtaaaatttatgtggcttttgccattttacaaatatccaaaatataccgattgcaaataatattgcaacagcggattttatgattcattccacgcttatgaatgaacagtattcacatcagattgaaaattttaaaaatacagtggatgtcagagtaaaagaaatgcagtgatggatatgataaatagccaaaaactgtccgctaatagaatttacaacagaatatagagcagataaagacgaatggtatcagatgtgccattcgtttttttaataaaagcacaaattaacctacttacgagcataaaatgatgtgcgttgggttgttttctggactatgagaatcaaagtcccattgatatgattaacatggaaaagaggtgcaaaatcttggacacaggaagaaaagatgccaatatacagataggaaagagactaagagaggcaagactgaatatgaacctcgaaaagtcagaaattgcggatgtattggatgttacagtagaacattatcgaaagcttgaggcgggtataacgggaatatctgtagataaagtgttgacactctatcataaatatggaattgatcctacatatctgataacaggtgagagcagtatgaaagattttaatctggattactatgttgcgaacagcacaaaggagcagagaaatgatttttttgaccgtgtgctggcttatttatctaagttgattagataaattgaagtgcttcctacttccaagcccgaaaaggaggaagtgttatgcttaatattgcggtctgtgatgacagcagaacagatgtagaaatgctggaaagtgcttttgataagttagtgcagtaccagttttcttatgaagtgtattttacagcgaaggagttgctgaagcatgttatagatgatggggaaatgtatcatctgtatatatttgacattgaaatgccggagatgaatggtttgcagcttgcaaaagaaatccggaaaatagatgccaaagcattgtttgtattcctgactggatatacgcagtatgttatggatgtttttgaggttattacctttgactatatttctaaaccgattacagtggaaaagctggagtccgtccttttaaaagccatgcagtatcttcatatgataaagcgtgactttgtctttcagttccgaaaaaatcagtttcgtattagctgcgatgatattgtgtattttgagaagaaaggtcgtcaggcagtgatacatacgatctcagaaaatttcaaggcaaatatgacaactgaagaaatatggaaacagcttgatgataaggtctttgcccatattcatgtatcatatatcatcaatcttgggcatatcagggcgattgagggagatgaagtagtgatggacaatgaagaaagacttctgattgctcgttcccataagcagaatttaaaagaaaaacatatggagtttgtaaggaggatggtttaaggatggaatatgtgatacgctttgccatcagcctgtttgatctggcagtgtttatgtattattttcattccaataagaaaatgaaaccagtatcaaaggtatggatatgggctggatttaccattgctgcaattatatggacatttgtcagcaacataaaaaatccgtatctgaatcttgcgactcttttgattgtgcttatactgttatcattttattatgaatcaggaatgtggacgagaattataaatattgtgacattcatgggtattggaatgctgtttgaacctgtagccttgctgttactccatgcgatgaattttcatgtgggcgaaagttataaatattattttgtaatggtaatatgcagctttgttcgtggaaatgtgatgtatattctgtcaaaattgatttcaaagaaagggatgcagattgccgactttccaagagaaattttgggtgtgctggttatggtatttacctttacggtgttgaattgttgctttgttattcttttgtcattggaagctggcggtgaaaaaagcctgcttatgtgtgccagtattgtaatttccattgtcctgacagattattttatgctgtatatgatggaacgttttaattatcttgtgcaaaaacagtatgaggatgcaatgtacagggaagaaatgcactataaagacatctattatgaagaagcagaaaaacagaataaggaagtgcagaagttaaagcacgatatgaaacataaattgcatgaactgtatcatctggtggaaaatagtgatgggcaggaactttcagagaaaatcggtgcgatgtgcatggaatttgagcagatagatgaaaagcagtattctgataatccaatcgtagattctgtgctccgcattaaatttggcagggcaaaggcaaggggaataaaagtagaaacatctattcgtattccaaagcagatgcagcttgatcacggggatataggtgtattgtatggaaatcttgtggataatgcggtagaagcctgtagcaaggtgccggagggacagcgttttgtaaagattgaaaataagtaccagtccgggattttgcttcttataataacaaacagcaaaacaggaaagaaaaataaaagcctgaaaacaaccaagaaagataatatcagacatgggcatggtgttcagagcgttcgcaaagtggtagaaaaatacaatggaacggtcagttttacagataaaggggatatatttgaggtttctgcaatgctctatggaattgaagtgaaggaataaatgcaaagcgttacacttaaatgtcaatctgttacactttgacggattttcctgtaaagtatgatatagtgcattcatcaaatgaaaaggaggacatacatatatgtcaaaattaagaagattgatgaaccgactcagtcatggagcattaagcagcgtggcagcacttgcccttacggtaactgcaacaaatatgaaccgttgctgctggtttattttcggacaggacaagttaccggataatgcgaaaaaacttagaaaattttaaggtggtaacagggtatgattgctaaatttgcaaagaagataaatgaaatattgatacaaaaggggattgtgcaaaaagaggatgcagaactgtaccaatatgggatagaaaatggtattgttgttgcaggaaaccttttggcttctggaatatttggcattgtgacggggagaccgggacttgttctggtcttcctgttattttatgcctcgttgagaagctatagtgggggcagccactgtaagagtagaatcggctgttttttgatatcaatggcaattttatttattccggtttatacatatgagcctgtaatgaaaaatgttcctaatgccttgattttattgatcggagttcttgccgtggtaattattattgtccttgccccagtggaaagtatcaataaaccgcttgatgaggaagaaagaaggtattatgcaagggtaacacattgcataacggcattgcaggtatgtgttcttatcattttgttttgtctggatctgcaagattatttttatgctgggtatgtaagtatagtcctggtagcagtatttatggttatgggaaagattgcagtgaaacgatatgtgcaatagaaaaatcttcttaaaatgatatattaaatttgtgactgcttttacataagattgggctaagatgggtagaaatttacgttttgtcgtattttgtgttgaaaaaatcgtacttcgtgtaagatatattgaaaaaagtaggaaaaatgatatggttatggtgaagtagtaaaaaagttatcaatagtatttgtaatagtttgtataattgatttttttgacagcaaaagcaacaatgaaaaatgtgccgtcaagatgatggcacattttctatatatatgatatttatttagataatatgcggagtgctttatatttatttaatggaaaaataaaaattaccgatatagtaggaagataggaagaaggtgagtaatatgctggaaattgctgtttgtgatgacgatatagcagatcttgagtgtgcagtgaatatgctgcataagatttttacaggtcaaaagattgcttatcatatagagaaatttatgtctgcaaatcaaatgcttgaaaatatcagtcgtattgatatcggaattttagatatttcgatggaagaactgaatggtattaaactggggagaaaattgaaagaaaaatttccagatgtgaaattagtgtatattacgagttatgaagaatattgtatgcaggtcattaacgaagttcatgcattttcatttctatgtaaaccactggaatatgataaattggaattgcagatattggaacttctgaatcaactgccggatgccatagtagaaaagaatttttataaagtgactgacagcaatggaaaagagtatctgtcgatcaaactgaaactgagggatattttatattttgaatacataaaaagatccagaaaagtactgatagcattgtctgatattacatatgagtatgattgtatctttgaaaaactggttgaagaactgcaaccatatgattttgttgtgaattgtagaggaaatctggttaatttaaggcatattgaaaaaataaagggctttattatttatatggataatggaaaagaacttcagattgcacaaaggagaagcaacgattttagagaagaagtaaataaatttttgcagagaaattcataggaggaaaaatgaatacgattttactggtattatgtaatgcactttcatgttttataataagtacgatattatttcagtttatgaatggaaagtataaaaagagtagtcgaaatagatatgtatatattgtgattgagactaccacagtaatatttacattctgtataaatatgctcaatcattccatattaaatctaatagtctggggcgttttgacagggattatagcatatgttctgtattatgaggatatagataaacccttaagacgtattattgaatgtgaagcattagtattttgtatgtctgtttgtgaatcattgggagtgattcttttacaatgcattttgcaagccgcagatataaaaaatgtgaatgaaactatgctttattgccttgaggtaacattttcaaaggtgatacttatttttttgtattacacatttataaacaggtttgtgaaaaaaagtgatgtcccttattcaaagacacggtacatcatgtatggaattatacttctatacagtctgattaacatgagtgtaattgtagagaattttaaaaatggagaagaaaattatttgtgtgcagtcaacatgggatgtattgttctggcagatttataccttttatattttgtaaaaatggcagatgaaaagaactattacgaaaagcagttgatcgcattagagcagcaggcaaaggtacaatacgaatactatttgacccagacaaaaaagtatgatcaaaccattcagatattacatgatgtaaataagcatattaaagcaatcgaagggttatatggtgcagagcaggaaaaaacggcaggagaatatgcaacaaagatcagagagttgttgaagccgctcattccggttcaatacacagaaaatccgatcttgaatatacttcttactgataaagaagctgttatgagagaaaaggggatttcagtaacaataaaggtagataatgtgaatttgaatttcattgaaccaatcgacattacaactatttttggaaatttattagataatgcgattgaagcaacagaaaagctgaaaggcgagaaatatatttgcattaagattggttcatatcataagatgatagttgtcagcattgaaaataattgtaatgaagtaaagtggagaaatggttttccagtatcaaataaaggaaaaaatggtggaataggactgctgaatgttcagagcagtataaaaaaatatgatggagatttaacattgaagaatgatggaaataaatttattgctgagttattccttaattcataaaagagcatttttggctatttttttgtaaaaagtcttacttcgtgcaaaaaaatcgtacttggtgcagaaaaggtaaaatatcagaaggggtgtgtcgatagaaaaaataaagtggatgatacatataaaaaatttaatgatgggaggtttcgcttatgtcaagaattacggactacggttttttatttcaaacaacatttggaacatcaaaaacaaatttggtcaacaatattcagttgtccaaaatgaacagcagttctgtacaaaaacaattaaaagcagcagggattgacacaaacagtaaaaagtataaagcagcactgagtgagatgatgaagaatggaaacggtgcaatgtttacaaatgttcaggcaattaagaacctgatgagccagtatgacaaaaacggagactggattgatccgaataccggattaacaggacttgctgtaacggatgagaacagaaacagttataaacatatcatttctattccagagagcagccgggaagaaatgtttgaactggcaaagaaagaattcttaaatgaaaacggtactttaaatggtgatactaccaaaagggagagcgtatataacaatttatacagaaaaatggataaggatgaccgcttatcagcaggctggacaatggaacaatatgaacatcaatacagacaggcatttgcagaagcagcaaaagccgctgatcctacatggaaagctgggaaatcaataccggctggtgcattggatggtattaccagagagtctgttgagagtggcaagaaatcagtagatataaaaatatagtatgttttttatgtggaatatatttcatttttgaaggaggttgctaatatgagaatatcagaaaaagctaaaaagacggtttcaagaaaaacgtttatggcagttgttgtaagtatgatggtttgtttgctttttgtaacaccagtatttgcagcttcaagtttttatagtaagacaactactaagctgaatgctattaatggaggaaaatcaacaaccagcagtttgtcatctggtagtataattggatcagatgcttcaatcacacaggttaaattggcaatcaatgtttcgagtggaactgatccatataccctttggataaagagtccaaatggaagttggcattcttatacaggtccgacatctagtaaaatatggtatttagacgattttaatggagaaaatccgtcaggtacatggcagatatatattgtgaattcaggaacaacaactcatggaaacatatatcctgtatcaacggttacagtaggactgactgtgtattataattaagaatcaatggtgctgttaaataagaaatgaagtatatgccataaataaagtcctcttgaaaggaacagtaagttcggtacaagaggacttttttgtatgtttttataaagtattatattgtatggattcaaaaaagcggcaaataggattcatttcaatgacaagtgtttattattaagaaaaatgtcacttggagtgcataattttaagtgtaaatgacacatacatggacgcacaggaggttatgcacatgactgattatagcaaaattacagccctttactcccgcctttccgtgggcgacgaggacagggacggcggcgagagcaacagcatacagaaccaaaaaatatttttggagaactatgccagagggcagcacctaaccaatatccggcactacatcgacgatgacgaaagcggcaggttttttgaccgttccgcctactcccgcatgatggacgatgtggaaaacgggaaaatcggtgtctgcattatgaaagaccttacccgctgggggcgcgactatctccaagtcggcaacgcgatggagatattcagacggaacaatgtgcgctttatcgcagtcaacaacggcattgacagcgagaaacccgacacattggagtttgcgccctttatcaacatcatgtcggagtggtacgcaaaggacatcagcaagaaagtgaaaacgggcattaagaccaaaggcatgagcggaaagccgattgtcaccgaagccctttacggttatgtcaaagacccggacaacaaggatttttggataatcgacgaggaagccgccgaggttgtccgtttgattttccgtctgtttatcggcgggaagaaccgcaaccaaatcgccgtatatctgacacaggagcaaatcccaacccccactttctacatgaaagaccgagggcggggaacctgtaaaaataagacactcaacgaggataaccgctgcaagtggaacaaagccaccttgaccaatatcctcacacggcaggagtattgcggcgatgtagtcaacttcaagactacaaagcatttccgggataaacataaccactatgtagaccggagccagtggcacatcacagaaaatgtgcatgagccgattatcagccgcagcgattttgaaaccgtacagcggattttggaaaacgcacccatcagacgccccaacggggacggggaaatccaccctctgtccggcttgcttttctgtaaagactgcggcgcaaaaatgcacattcgtatagattaccggaacggcggcaagcggcacgttgctttttgcagcgagtaccacaaggggaaagccaagaaccccaaatgccattcccctcacatcatggacgcggatttgctcatgcagaccatcgcggaagtgctgaagaaaatcgaggactgttctatcagcaaccgggcggagtttgaagccttagtgaaaaagaaccttgccatgcagcagaccgaccagaccaagaagcagcagaagcgtatcccgcaaatcacgacgcgccttgaacagattgacaaggtgctgaacaagctctatgaggacaacgccctcggcgcgatcccgcaagaccgctatgagcagatgtcgcagaagtattcggaagaatactacgcgctgaaagcggagcttgccacgctccaagagcagctatccgcttatgagaacgcgggaggacgggcgcagaagtttttgaagctgacggaacgccatgctgcctttaccgagcttacccccgccattctcaacgagtttatcagccggattgaagtgcatgagcgcgaccagaaaagggcgagatacgcaatccagcacatcagcatatatttcaattatatcggcaagtttgagaacgaagtgacacagcttgcagagccgaccgagcaggaaatccggcaaatgcgggaggaaatcgaagaagccaaaaaggaaaagagccgcgcctaccaccgcaactattcaagggaataccgggcgagaaatcttgaaaagcagcgggagtatgaccgcatgaaagcgcgggaataccgggcaaggcgaaaggcacaggcagccgcacagcccgcacagtaaaacagaataaccgtcaaccaagagggattttccgaactacgggaaatccctcttttgcgctcaaagaaaggagccgcctatggcagaacagacccccgacagtatcattacgacccagaggaacgggcagaccattgttgtggagttatttttcaatcacagcagcacagaaacattccgcgacaagctgctcaaactggcacttgccgacagctcgcgtttatccgcgtctgacggtcaagagccggaaaaacagaaatcttgcgataacagccgccccgacgaaccattccctgtccgggcgttttctatttgaaaatcctcattttccacaagtcaagagccgggaaaaacacccgaaaaatgcccctattgcgtaacaggggcatggaaaggagcttacatgagaacagggcttaccaaacaggaaaagaccaccgatatatggtttgacgagaaagacccccttatccatatccgcacacacaacaccgacttaaagaagcggcttgccgcctactccggacagcaccccgaccagtgccgccagaccgacgcagaccccgaaacgggctgcatggagtttgagattgcaaaggggcgtttctctttccgtctgaccgccccatacagtgaggaacggaggaacgccgccagcaaagcggcaaagaaacattccggcaacttgacacaccctattcaaaaagatgtgctataatttttttgaaaaagtttcggattagatgtagtatttgccgctgaaaccgtagtacataggtgaagcccgaaaggaggcggtgagatgatagacgacgaaaaaatcatagaaatgttttttggacgttcagaacaaggcatacgagagctggatataaaatacggaaaggtctgccacaatctttcctaccatatcgtaggcagcagacaagacgcggaggaatgtgtaaacgacgcttatttaggcgcatggaacgccattcccccggcacgacctaacccgctgctatcttatcttgttaaaatcgttcggaacatttcactcaaaatctattggagaaaggaagcagccaaacggagcagccattacacgattgctttggaagaaattgaagcctgtatagcagccccgaatacagtagaagcagaaatcgaagccaaagagttagcccgtatcattgaagcatttttagacacgctgactaccgaaaaccgcgttattttcatgcgccgctattggttttccgacagctataaggacatagccgagtttatggggctttcagaaaaaaacatttctgtccggctgacccgtatccgcgagaagatgaagcaatatttgattgaaagagaggtattcgtatgaatgcaaagaagttttccgacgctatgagcgagcttgacacaaaatatgtcgatgaagctctcaactacaagaagaaagccaaaaagcccatttgggtaaagtggggggctattgcagcttgcttgtgcttgatgataccattgaccgcatttgccgttgatataattcaatataatgcagcggttgattatctcaattctctcggcattgctgttgaagatttgagcgactattctcataaagaaataaaagaagctgcaaaaacgattgacgcaggagaaagtaacccgttgactgaagaaatccttagtctaataccagaaaacaaagaaccgctcgatacaccgacgcaggtaacatctgagcaaattaaagaactaacaccgaccatgacaagagaagatgttctttctcttttaggtgacacacaagatgttggctcaggcatttatatatatctttacgaagtagaccaacaatacctgttgcgtattccttttgcaagcgatgaagcacaattaggtgtaacaggagaagatttgctaaaggcattggttcccatttctggagatattgctcctatggtctatgtaaatgatacgctttatcaaatcgttgactctcaacccaacttcgcagatgaaaaaagttctttcaatttgttgggaaaaatcgaaaacacagttagttcttcggaagaaccaaaagaaaatttccaagcaaatgatgatattgtaggggctgcggtttatcagtacggcgataacattgtcgttgagtttgagggaaaatactggttatatgaacactatcataacacagactttgacggaaactcagactgatatgccccacgcccaaacaagccatacttctgatgaaaaagtatccgaacaaaaccttcttgcaaagtaaataagttttctattttacaagggcagccgagaaaatcgactgtcctttttctatgcttatgagcagaaaggagcgcccaaccatgacaaagccaagagagaaaacccgcgaggagttgcaagccgagattgaggacggaaagaagaaaatccggcaatttgagaaccgggaaaagatgttgcgtcagaagctatccaaagaggaacgcagaacgcgcagccaccgccttatcgtccggggcgcagtctttgaaagcattgtgccggaagcaaagaacatgaccgacgaggaagccgcagcacttcttaggcttgccttgacgagtgaaccagcgcgggaatatctgaaaaaacgagcagagggagcgacaagctgaaaatcccttaggaactaagggcgcacttatacacccttacgggcgtgtgcgctctgccgagggcttatctccgcacagggagatttccccgcgctccgatatggcggctttgccgcaacaaggggctgcaccccttgcgccgcttcgcggctatccctgcacacccacaaaaacagtacacccgcctttggcgtctgtaccatttttgagggttttattatcctatccgggaggtgatacccatagccatttaccattggaacatcggcattgtgagccgaggaaaaggcaaatcagccgttgccgcagccgcctaccgaagcggcgaaaagctgacaaacgaatgggacggaatgacccatgactacactcgcaaaggcggcgttgtccatacagaaatcatattgccgccccacgcaccgccctcattcgctgaccgttcaaccttgtggaacagcgtggagctttacgagaaagccgggaacgcccagcttgcgcgtgggattgacgcagcactccccatagaattatccagagaggaacagatccggcttgtccgggaatactgttcctctcaatttgtttccagaggaatgtgtgtggattttgttatccacgacaccaacagcggcaacccccattgtcatattatgcttaccatgcgcccccttgacgagcgcggcgcgtgggcagcaaagtccaaaaaggaatatgaccttgatgaaaacggtgagcgtatccgcttgccaagcggcagatataagacgcacaaggttgacctcacgggctggaacagccaagagaatgcgcttgtttggcgcaaggcatgggctgatatttcaaacgactatcttgagcgtgccggaagcccggagcgtatcgaccaccgcagtaacgccgagcgcggcattgacgaaataccgaccatccatatgggcgtagccgcctgtcaaatggagaagaaaggtgtagccaccgagaaaggcgaactgaaccgaaatatccaaaaagcaaaccgccttatccgggaaatccgggcgcaggttagcaagctcaaagaatggattgccgacctgttcaaagtgtgggaaaccgccccgaagcagccggcgcaatctcccaaccttgcaaatctgctgatgaaatatttgagcgttcagagagaaaagagccggaagtattcgcagcgttggcaacaacagcacgcagccgatgaactgaaaaccatagcggcagcggtcaactatctctccgagcatggcatctctaatcttgacgagctggacgtttctctttcctctgtcagtgatagagcctattcaatccgggcaggaatgaaaaccgccgaggaacgcatgaagaagctacaaaagctaattgaatacgggaagaattacacagagtacaagcccattcacgatgaactgaaaaagctgcaaaacggctggacaaacaagcgcgacaagtacgaggaagcccaccgcgccgagctgaccctatgggacgcggcaaaccgctatctccatgcaaatctgccgaaaggaacaaagaccttgcctattgcggaatgggaacaggaatatgctgacctcaaaacacagagggacagcgattataccaaactgaaagatacccgcaccaatgtttcaaagcttcaaaaaatccgcaaatgcgtggatattgcactccgcgccgaccagccggagcagacgcagagccgcaccaaacggcatgatatagaccgctgaaaggagttgaacttttatgtattacacccaagaacagatagaccgcgccaaccaagccgaccttgtttctttcctgcaaggacggggcgagcagcttacccgcgccggaaatgaataccgctggaagcggcacgacagcttgaccgtccggggaaacaaatggtataggcacagccagagcaaaggcggcgcacccgttgattttgtcatggagtttttcggcaagagcgtcaccgaagccgttgaactgctgacaggcgaaaaaggagccgccccgccgccggacagaccaagccccgcgcccctatccgacttccgactgccaccccgcagcaccgacaaccgcatagcgaggaactacctcacagcagcccgccgcattgatgaagatgtgacgggctttttcttttccaccggggatatttacgaggaagccgcccaccataacgccgtattcgtcggcagagatgaaagcggcataccgcgatacgcccatcagcgcggcacagccgggagttttcggcttgatgtgaaaggcagcgacaaagcctttaacttctgctaccgtggcgagggcgaaaggttgtttgtctttgaagccccgatagacctcttatctttcctctgcctgttcaaaaaggactggcagaagcaaagctatctggcgttgggcggcgtgggagaaaaagccctgttgcgctttctctctgaccgtctgaacatcaagaccgtttacctctgccttgacaacgacaacgccggaaacgatgcttgcagccgccttgcggagcttgtgccggagggcttgaccgtccaccgccttgtgccgctttacaaggactggaacgaggtattgcagcaccgggcagaaatcgcggacggtaagtatatccgggaagcgatttacggcttgaaagagccaccgcaggaagaaaccgttgagattatccgcatgagcgaggttgatacacagaccgttaaatggctatgggagccgtatatcccctttgggaaagtaaccattgtgcagggcaatcccggcgagggcaagaccacttttgccctacgccttgccgccgcctgcaccaccgggggaacgctgccgggaatgaagcccttgccgccattccaagtaatttaccagaccgccgaggacgggctgggcgataccgtcaagccacgcttgatagaagccgccgcagaccttgaccgggtgcttgtgattgatgaagccaaacgggagcttaccctgtccgatgagcgcatagaaaaggcaatcacgcagaacggggcgcggctgattatccttgaccccatacaggcgtacatgggtgaaaaaaccgacatgaaccgggcaaacgaagtgcgccccatgttccgccgccttgccgatgttgccgagcgtaccgggtgcgccgttatccttatcggacatctcaacaaagctgccggagggcagagcgcataccggggcttaggttctatcgacttccgcgccgcagcaaggagcgtcctgctgatcgggcgcgtgaagcgagaaccgaatgtgcgcgttatcgtccatgacaaatcttcccttgcaccggagggcaagcccgttgccttttgccttgacccggaaacgggcttttcatggataggcgaatacgacatcaccgccgacgagctgctgtccggcgcgggcggcaacaacgccaccaaaaccgaacaggctgaaaggctgatacttgacctgcttgcagacgggaaagagcttgccagcgaggacgttgtaaaagccgcagccgaagccggaatatccgaaaggacggtacagaacgccaagcgcaacatgggcggcattttaggcgcaaggcgtgtcggcggtcaatggtacaacttcatcaagaagaagcagccacccgaacccgcaagctgaaagtgcaaaacgcagaccctttgcactttgcgctttcgcactttcacgataatttgcgtcaataactcaaaaaagcacttgacaaaacgcttcatgatagataattatggaaataattacattggtttgttatactaaataaaaagcaaagggggaaagttatgtttaagaagatgccggtatgcagactgatgatttcgtgtccttctgatgtaaaaacagaggtagagattataaatagagttgtggataatataaatgattctataggtatttctatggatatttttgtaaaaacgctgtattggtcaaagaatgttatgccagaagcgggaaattatccacaaagcattatcaataaacagattttagataaatcggatgcaattattgctatatttggtaatagaataggaagtcctacacaacattatgaatcaggaacaatagaagaaattgaattgatgatacagaagggaaaacaggtatttgtatatttttctgataagccagtacgaaaaagtgaaattgatatggaagcggagacaaagatacaggcatttaaggagaaatacaaggacagaggaatatatgttgtttatgcttctgatgaggaatttaatgattatgtcagtatgcaccttacacgctatcttacaacggaacttgcaaatgaagtaaatcgtgtgaatgagcatacaagatttgacgattctatatcacagagaaaagaagttgatttaatttacgattatactaagttttatgatataaaacaggttagttcttatactgattcaaatattatgaaaataagaacacataaagacagttttgaaatggatattgacataatcaatgtaaataaaatagaaaatcaggaatttgcaatggcattatttgaatatgctccatgtgataactggtcagctttttttgaagcaggatatttttttgaatttgatgcggcaagtagtggagatataagagcttttcaattggaaataaaagatgatatacgaaataaggtaattgatagaacattacaggttagctgcgaggaagaacatttccgaatatggattccttctacaacaagagattcaactgcgtggaaaaaaatatcgcaggtttgttttgttgtatttttcaatagtacatatattgatggagaaaaaggtctgttgacaatcagaaatcttaaaatggtgccccgataggataatactttgaaagtatgcagaaaagtctaaaagatattgaggaaaatcatgtaagaggtaatgatagacttatttaggtaggtaagcaattttcggatttaaagcagtaacagaaaattaaaattgtagataagtaaataaaataatagaaaaaattatatgcatctaatccatttgcggtttaggtgctatttttttgacaatatgaatgcgatcgctcgtaatatcaatatgtttatcaataaaaatatatgaagcaacagaacagatgatattatattcatcagcatttttgcttttttttgctttttaataagtgaaaagtcttacttcgtgcaaaaaaatcgtacttggtgcaaaaaaggtaaaattttataagatgcttgtcgatagaaaaagaaaaaataaggaggttttcaagcatgaaaaaacttaatgatgtagcattgaaattacttgcaaaagcagcatatgcaaacgcagagaaagaggcaaattcagcgtgcctgtttattggctatcagcctaaaatgccacagaaagtaaaagaactgaaagaaagaaaatagtattttcctatggacaaattgctgaaaaatgttctatcttgcatgaggacaaaaggacttctggataaaaatgaggaagatgtatatcgctttggcttagaatgcttattgttagaggtggtacattacttgtcatacatagtaattggttttgctatgcgaatgataatacccatgattgtaactgcaatggtgttaataccattgcgtagaaaatcgggtggctttcatgcgagaacaaggagtggatgctatttattttcatgttccatagttgttgcggtatgtttattggataaaatcatttttccactatggttatgtactgcaactacatttggggcaaatgcaattatatttgcatttgctccaatagaaaatgaaaatcgaacattagatcaagaggaacagaaaaaatttagaaaacaggcgttaataattttagtattggcagatatggcaattattatatcacacaaaattcatattgaagtatgccagtggttattaaacggtatgatagttgctgcactactgaatttgtgtggaaaaattcagacaaaatgcaaattagaaaaaatatggtaggaactattgctaaagagtggaaaaaggtaacaaaaaattgtttccaataaaaaattatcgttgtgttggaacaaacatacttgtatagacgagaagttttgaaatcgctttacaggaggggcataatacttggttgtgttatgttagagacagatagggtttacattagttacatggcaatagctgttatattatatgcagctttgcttagtatagcaaaaattttaaataggaggtgagaaagaataaagcagattaataagaatgtgctgaaagttgtagagcgtgtcatgagaaatgaagctgtatatgggataaatggattttccacaccatgtatggaaatacttcatcagccgaaacgcccgattagccagaaaaaaagtgaaagatagttagctggcgttttttactattatatctgtagccatagatgctataggaatttaattatttattctaagatgacaagtacaaaaaggaggaaagatagtaagcgatgaataacacaccgcctacccaaaacagtaaacgactaccatttactttaggttttccctgctatctacatggcaggggaattctgttttccgggacattggattccacatcaatgatccccgaacactgctctttgataaattcactccatggcatcagctgttctatacctgcggacgagttcatataatccggcatatacagcagtaccatatagagatattggaaaatattcagattgtttgcttttgctgtttccacaatgctgtacattaccgcacttgccccagctccagcttctgatgtatggaacaggaaggctttccgcccaacggcataacttttggctttccgttccgcacggttgtttgaaatttcacaccggccatctatcatatagttcatcaaggtatcatgatgattttgggcatagttcaccgctttcccaagcttgcttccgccagttggatgcagtgtgccaagccagttccagaactgttcccatacaggctgttccagaatggttctttgttgttttcgttcttctgcctccagttcttttaatgtgcgctccaggtagaagagcttattgcaatacagcagtccaatttctgccgggagcagctgttccagcttctcttcatccggaataccggtatcctcgatcgcttcatcagagttaacatccagaagtttcaactttttacgtctggctgccgggactgcttcaaagaacttacgtcttgcatgtgcaaggcagcagaccagtatgacatcttcaagcctgttgtaaccctgatatccgtcacactgtaccattccatggaatccttccagaaattcctgcacacaggatcctttccggcttggctggtaatcataaaggacaattggtgtaagaccatcatttccggttgtatataaccacatataagaggtctgttccgccgtacgtcccttttcccgcagcacctgacatgttgtctcatctgcatgtaccaggtcccgctttaaaagttcttcatgcagccgatcatagatcagatagaaatagttttctgccgtataaatgatccagttcgccatggtttcccgtggcagggtaaatcccagctggttcatcagaaattcctgacgatagtaaggcattgccatgccgatcttttccattgcaacatatgcgaccatggatggggaagccgggctgtgtggaatcaatgctgtaggtatcttggattcagcaaatgtcccgtcaccatcttttctgcattccgggcactgccatttctcctgataatagtggattcgttccacctttgccggggtgatccgtagttcttcacggacaaacatttccgtcacatactccatcttggaattacaataaggacaatacttatcttcttccagcagggggatgacttccttatggatcggaagatttccatattggtcttcacgtgtcgctttcgctttgcgtgttgtccgtttgtggcttttgacgattgttgtcacagtttcttccgttttcttatcctgttttgtcttctcactgcctgtaccaaagagtttccgctggaattcatccagtgtttccctgagaccggcaattgtatctttcaggtcattgatggtttccttcagttctgtgatggtttcgtctttttcatctaaccgttcagaaagcatctggatcataaggtccttctgattcatctcactgttaaaaagtatgtcctgtccctttgaatccacggtgaatccctccctcttttttcgttacctttattgtacgaaaaggaaggcatggttgcaaatgccgtccaaaatcagactggcattatgccgaaagccagatagctcctttttttctcaaaatcagccagtttccgggattttccgtaaagttatgcacatcatgatgatgtcatgctcaactatccccggacaacgcaccccatgatttcacatctgtggatatcttccgtcaacagcctgctccggctgtagaaaaatttttcaaaatctacatattgcacaaatcagtaatccctgtctttcgcaggctgtatcgctttcggctggtcaatggaaagtccttccatcagccagcggaattcctgccttgtcagaggtctgacttctgaagcattgcgtggccattggaattttccattgtccaggcgcttctgcaggagtacaaatccatcccggtcaaaatagagggctttcatcgtattctttttgcgtccacagaacagaaagaccgcattggagaacggatccatctggaaattgtcacggatgactgccatgagtccgtcaaaggattttctcatatcagtccttcctgtaaccagatagattttctgtactctggacagatcaccgatcaaagtttccgcagggcagatatcgtatgatagatcacatccctgcctgcatgattattgattgcaactttacagccgtttatgataactgtcagtgcttcgccctctgatgttgcatctgttgacagcagtctgactggattcgatatcggtatatgcgattcttctgtaatggaaagtggtacgatttcatgtgtggcatccacgattagcctgtctgtctccggaatcatacatgatttctttctcagccttgtgacagtattataaaacgtattgatagagatatcattctgctcacaccagacacggtcagaaaatccactgctgcgacattgctgaattaatgacagccattcttcgtctgttcttctcttattacgcataagctgctcctcctgttagctaaagtagttaaacaccgtaaacggctacctttgcttaagaaaagaagagtgatacgtccgcatccagatctgaaaatagataaagtagtcgtttactgtttattgactgtattatcccaaatcttcaattaaatttggaacggtatgttattcatcgcttacgaaagataatgaaattaagaaacaaagcagcgatgttgttagcattttccatgatggtatctttaggaagtgtagcaactgttaatgcagcagaaatggaaaatgaattttcaacattgaaggagagtagcagttttgaagaagtagcggaggttggctctttggaacagttcaagggagattcaattgataagattaagatggacgatagtggcatagcattaactgctactggtgattcttatgaggcgaacaatggtccggctgttgctacaaagggaagatataacaagatcacatatgcttcacttcatgatgcaaatgatgtagattggtatacaattgaagtattggacacttccaaaccgattagtgtctttttgacgaatataccaagcggctgtgattatgatatgtatttattgaagtatgattctacacttggaattactaaaatgtattataatcttcagagtggaactacggcagaagaattgtatggaactgtggatgaagtcggtacatattatgtagttgtacaagccagcacatcctcatctatagagaacaattttagctcatctaattatacactctatatgggcgattattacagagtaggtcagtatggttatgtagatacaggtttggatattagctttggaaatataccagtgggaaatacaactcctgtatataggggatggtatacttatgatttgagtaatgaggcaagtattccaaatgatgctattgtaacaaaaatatatttgactggtaatggaaatggtgcatattggcttggcttctataaaatgatggcagcggctggtcagggaattcaattagaatcaaaaattggtcaaattgaagtaatgtattctggggataatcagcttttggctaaacagaaatggttaatcggtggcaaaattatggcaagtacaaactttgtgtgggaaccacagattttaattgcatataagtatgcagcaacaatttcaaatatgagattttttgcttgatttacaaagagtgatttatggaaacataaacgataattacatgcaattttacttgcgagaatatttttacgcttcttagcctgtgcagactaagaggcgtagaagtatgtaggaggttgagatgatgcaatcaatatcaagttatattaatcctaatacaagagggcttacatctaattataaaaatacagctattaaagataaggaagcatataacggggtgatgtcgcagcacttactaaatccggtagaggatctggtacaagcgttaaaaacaccaataaaattggcgaaaagtgcttcacttagcagacagaataattctgttaatattgcagaaggacaaagtattcgtgttaatggaggtcatgtgcttacggttacgacgcatggagtagaggtttctggtggagataatccgtatgatacagaatcttatgtaaaagcacaaagaatggcagatgcattggcatcaatgctacgaaatgcaggtgggacaatgactactgtagcacattccaaggaggaatatgcccggtatatagaaggaattacggatgtgatgtcttatctgggtatcgacacttccaaagattttacggtcaatggtatgcgatatagcaaaaataaagatggctggtatgagtcagaagcgaacagtgatgcacaggcggcatatgaacagttaaaagcgaataacagaacctatcagtttgcagacgaaaagaccaaaaagcagattgcatatattagagattattaccttcagacggtgccggagagtgtaaaggcggcatggcaggaaacattggaagaaaccagttttaatccatttcagacggatgcagtcagtaccttaacgcagttatctgtagagcaggattttctgacaggtggtgatgacaatatttttggagaaacgaaagaaagttgtctggcagctattgataaaatattggagagaatagaaaacccgttggcggcagttacagaggaaagggcagcatatctgcaacaggaaaaagaattttatacagtgttggcatctaaaataggagaataattttatacatgatgcaaaaatgatattgaaataggaggaatggtagtatgtttaagaaaattaaaaaagtagtggcttttgcattagctttaactatgctaatgggaatgagtacagtcgcatttgcggcagagagagaaagtgaagttccagagttgacaaaagttgacggaatgacggtggctattgatgaggataatgacaatggcatcagtcctttgtggtggtctggtaatggtccggctccacaagtaactaaaattgaactttataatcatggtttgttagataatggaaactattgtgtcatcatcaaggtttatggatatggaagtgatactacaacttttaacggaagaagtatttcgtggtttaaacagcagccgtttataatttcaggtaatggtgcggatggcttttattactggtatgattgcggaaaaataacagcacctggtaattatacatttactacaaaatttagatctaccaatttcccatatggtgagaaatccttttcatgtgtattcaaaaaaagttaaggcaggaagtgggctagaatatagagagatttttaagctgattggaggaacagaagtatgaacattggttctggtctaaatacggtatcttcaatgtaccgccaacaaaaaggcaataatatgaaagcccctgtatctgcggaaaagacattttatacggctgaaacaccaaaggtataccagatattcacaacagataatatgttgtggacaggaggtaatggtacaggtctttcttattgccttaaatatgcggatgattcgacggatgaaaatccagtggtgttagcgaaaggtgtggatgaaaacggaaaagagtttgaacaaagaatttatatcaatgacgttgatccatcaaacgccacagtagtcgaaatgcgtgcattggaggcacattacaaagtggagaagcagggaggttttacgtctttgccgcttgaagctggtaatatggggcttaatgacagaagagattttatttcaatgtttaaagaatgcatagaagatttaaacaaattgggaaggtttgatttatcgttgctttggacgaaaagtatggatgcttatcttgatttgacaagtgcaaatagtaagtataaatagtgcttagtcatttgaacatatgagaaaaagaaaacttggacttcataggagagagtagcttggttatgactgagagaagaatcatatgatttctatgattatttagcgggtaataatattggagttattatatgttaatttgaaaggagattttaaaatgaagaaggtaaaaagtttaaaggcgttggtgttgagtttgatgttatgtttggcaatgggaacaactgcgtttgcaggtgaagtatccactcagggacaggctgcgcctaatgcaaataaggcagtagaagtaagcgattgtggcaatttggacgtagtacctgcttatgatgacgccgttgctcttgcagatacgattcggtatgatgcaaatagaaccattacaagaagcaattccagaagcggtgtattcaacggaaattattattacaccattaataactcaagcgttacaaagttgtgcttagatgtttatatgcctaataaaagtggaacagattatcttcagggaacaattactcttgtaggaagtgacggaacaagtgcaccggtacaaattgctaattattcgggagattcatggacactgacatttacaggtgttaaggtaggtgttagataccatttccattatgagttgtattctgttggctcttcgcaggtaggctatattgcttctgctgcttatgcacaataatagatgctcgaatatggaatattaagcaagcacaacagaatattttcattgtatgttgcattttatagaaatctggcataaagtgcaacatactataataaaaaaattagattatattgctgctggagggattataaatatggtaaatatggtaaataccgctgtaaataacaatatttatgcaggaagaaaacctgggtcaaaatataaccagtcacatacttttcaacaaaaggaagtattagaggtaccggatggtgcagcagttaacaaatatgcaaatgttcaagaaatctatgaggcattaaaatataacgcgtcatatagagtagataaacaggagcaggatgaaattgctgagaaagaaattcaaaatgaagaaccagaaataagcaatgattccagtgaaaaaatgacagcatggtatcagggtgttcctttgaaagaatgggcattaacggatcctaaatacacggattcagaaacgggaatttcatggtatattagagacggaaaatatccgtatatggtaggtgaggatgcagaaaagttccgaaaactttgtgaagaatccggggagttccctctaaagaaatttggggaaatgacgggattaatacagaaattagatgacaatacagtagcgtatgtgggtgataacggaattgcagttaaatctaaagatgggaaagagatgtttgtggacacatctggcttgtcatatgatattgttatggatatgttcagaaatttgcctagaaatgggaattttttcagcaataagtattggtcagataatatacagaaagcacaggctcggagctgatgatacgttatattgcaagagtgtgtatgcttggactccgataggagaaagcagattggttctgattgacagaagaatcatatgatttcatcattaatttggtaggcaataatattcaaattattgcctgctaaatttttaccaaaattcttctaataccgtttttggactagaaatgaaaagaaaatgaatatatcgaaagaagaatctgaaaagttagaaaataattggaagattggtttgattgtagtataatattaaaagaggtgcgagctgagaaatcagcatagctgatttcccctagcaagcggaagtaattctgcaagctttggtaagctgataataatacagtaggaaaaatcctatcaggtaaggtctaaccaaccgcctgtaccgagtccttggagccgaagcggtaacgttaggtttaagcgtaggacagggagcaacagagccgaaacgaaagtgaagtgattgagctgggaaattattatgaggttggaaatggtcgatgtgttcttattcacagcagacaatatcgttgtaaccgttagggcgaggttatgatggcatcccccagtcagagaacttggcgaggttgatgataagtatgttatcggaacagctgagatcctattatctcctcaaatgaggtatgatgtacaatcaaaggaataagagaggaagtcaaacggataataggaagtccgagtgctcatagtaccgaagaaactgctaatcacagtggagggaaggggcacaccttatatggatgtaaagaactattgcgtggacaagagagccaattagtgcaatgctcgaagttgaagtatagggttaagccgtatgccttaatagggcacgtgcggtttgaatgagggatatggggagcaatccccatatctacttaagtaaaagcacacaagaaggcccgtaaatcgaaagctgcttatgatgaggtctttgctgatcttccgacagagaatgtttatgtagatactcttacggaagaacagaaaacgtgtgatgtttgtggaacaatgatgattcctatcggacacgaacccatccggacagaactgcgttatacagagccaaagctggagcgtattgattattatgcgactacctatgagtgtccacaatgcaaggaaacggaagatccccggttcatcaaggacgaaggaactcctgcactgatcccggggagttatgcatcgtccggtcttgcagcacatgtgatgtattataaatatgtcatgtctatgcccttataccgtcaggagaaggactttgaacaccttgggataaagatcagccgtacgaccatggccggttggatcatctactgcgcagagaattactttttgccaatgtatgaatatctgcaccggaaactgttgaaacgcagatatctgatggcagatgagactccgatccaggtattaaaggaagaaggccgcagaccacagagtaaatcttatgtctggctggtacgaactggtgacaatggtgggattcctatcatcctttataattacactccgaccagagccggcagtcatgccgctgcttttcttgcaggtgcagatcccggatactatctaatggttgatggttataaaggatacaacaaagtgccggaggcacagcgttgttgttgctgggctcacatacgacgctattggctgcgggcaatacccaatgaacttgatccacttaaatatctgagcttccttctagagcatcgtcctggtgctgaaatgtcagacgaggaattggaacaatttgccccgtggagtaaattggctcagggaacttgtaaataaaatgtagtgaaatactcgtatgtctggcattctagcgcggggtgtcagatttaatttatagggtacgccctaaaactatgcgcttaccatttatagttataaaatatataataatataaacttaaactttttctaatacaattatggagggaattatggaaattattagtgtagaacatttgaaaaaatattatggtaaagtgccaaatcaaacaaaagcggtaaatgatataagtttttctgtacagaaaggagaatttgtttccataattggtagttctggcagtggaaaatctacgttacttaatatgattggcggattagacactccaacttcagggaatgtatatattttggggaaagatattacttctatgtctgaggaagaattgacactatttcgtagaaaaaatataggatttatttttcaaaattataatttgattcctgttttaagtgtctatgaaaatatagttttgccagtagaacttgacgggagaaaaatagataaagattttttagatgatgttttagatatactttcattaaaggagaaaatctttaatcttccgaatacgctctctggaggacaacaacagagagtggctattgctcgtgctattatatcgaaaccggctgttatattagcagatgaaccaactggaaatttggatagtaaaacgagtggagatgtgataaagcttttaagaacagtcaaccagcgtttcgaacaaacgctgattatgattacacataatttggaaatagctcagttgtcggatcgcataataaatattatagatggaaaggtagatatatgaaaaaaaatttttattataaaatgaatttaaggcgtatatggggattgtctaagaaaatttttttgtcaaatctatatcgaaatgttgtggtaattattgcggtagttttgtccacttttatgttgacatctgtgtttagtgttggatttagttatatagagacggcacaattacaacaaattcgtgcgatggggacaacggctcatgtggctattaataaccctagtgatttgcaagtatctgagataaagaaatcagattcgattaaagatattgggatttctcaacatttaggacaaattgacggtttggaagatgaagatttgttgctagggctaaattggatagatgaaaatgaatggaaccttcatagggtgcccactatttcagatgttgttggaaactaccctgttacagaaaatgaagtaatgatacctacatggattttagagcgtttgggaataacaaatccacaagaaggtatgtctatttctttgtcgtatcatttggatgacgatgattctattaagacgcaagagtttattttggcgggatactatacagactactctcaagttaggactaatgacaaaggaagcatttacgtttcagaagaatttaaaaataaggctgctatctctactggtaaagtagttatggtgtcttttgaagatacaggagatattcaaaaagagtgtgataggttaaaggacaaggtgaaattttcttcaacacagagttttgaaattgttcctgtaacacaagtgaacagccaagtattaattataggcattgtctttatactattattcatatttattagcggctatttgttaatacataatgttttatatattagtatagttagagatatccgcttttttggtcaacttcgattaataggatttaccaaaaaagaagtacgaaaaattgtttatcagcaagttttgtatattactgttattggaattccgataggcttgatattgggagctgcagtatcttttggtatcgtgccatatagtttaaatgtgctatattcggggaatgaagatttaggattgcaaatttcgttctctccgttcgtttttataggagccacaatattttcttttgtcactgcaagaatagggtgtgttaaacctgcgaaaatagccgcccaggtttctcctattgcggcaatgtcatataatgatgtggattcgaaaaaattgtataagcgtaggaataaggtatttagattaacaagaatggcgtttcaaaatatttttcgctctaaaaaaagcgcaatattggttatttcttctttgtttttagggctggcgttatattggatagcaacgtctttattgtcgagtattagtccggaaaactttatacagcaatggggtgaaagcgactttgcaattacttatagtattcatgatgatggaagtccaatcacggcagatatgctagaagatattaaaaatatctctggaattcaaaacttaagagttacctatgttgccaaagaacgtgttacttttgatgtgcagtatgatgaggaggtatttggcgcatatgtggattcattagaaggaaaagcaggtatagacttttcttcttctgaaaaacgcgaatcatatacggagaatttttatagtggtgtttatggaattgataatagttatatagaagaattaaataaaacacttgaacatcctattgatctagaggcgtttcaagatggtaagattgttgtgcttcagacaattacaaatgaggatggggaaaatttaattcaacctaatcagattattactataaaaactaaaggggccgagacggagtttgaagttgctgatggtttttttagcgctgattttcaaggagggaggggaaatgaaaaaggaacagccccggatttatatataagcaaaacggcgcttgaaggtttaacttctcaaattaaaatttttcgaattgcatttgacactgatggaaaacatgatgatgaagttttaatgcaacttcaaacgattgcttctttgaattcggatattcaaataatatctaggattgaaaaagctaaagagatggaaggttacattttgacaactaaagttttaacgataggattgtcttttatatttttgctagtaggaatacttaattttgttacaacaatgattacgagtgtaaataaccgaaaacaagaatttgcaattttggaaagtattggtatgacgcatagacagcaattaaagattttattgattgagggattttattattggataatttcatttatattattgctcatagtaggaaatggaatatatattcccttgtatttttggtttaagcaaattgtttcgtatgcttcttttaaaatgccgtatgcttctttgttaattgttttaataattatttttatggtatgtttagtaacgccgttttttgcatatcaaagcattttaaaagataggctgattgagcgaattaataagcaataatttcttcgcagatagaatttgagtgtagattagatagaagatttattactttttaaaaataaaagtccaatcaggagtttgcgattcaagagaatccataaccatgattagggcttttgcttattggtaaacgtggctatttagtaaggacaaactcgctgtatattgtatattgttttttaaaatgttaaaattaatcatattggtatgagtaaaaaatggttattatataatctttgagggggttgcagatggaattaaaaacttttttgaaacgtttactaaaaatagtagatatagagaaaaaaaagtatatcgttaatcagataaaatgtttttctttcttaatgatctatacaattgcttctgtaatatttcctagttttttaagcaaaattgttgatctgggagttgttatgggagatgtttcaaatatagtgttgtatactactgagatgttgatttgcgggatattaatggtaattttctattatttgcaaaaagtatttttttttaaattcggtaatgatatagtattaaggacaaaacaaaaattatataaaaagcttaatacagttgatattcaattttggaaccagtacaaagtaggggatgtactcacaattttagataatgacatagaaaaattgcaagaactactaacatctgatatcagcgaattggtagtaaatatttgtttgtgtatagggattagttcatatataattatattaaatcctaaaattggcattttggttgttgtaatgtcaattatatttgcatttattcagcgaaaagtggcaaataagagtaaagaacgtatgaaaaagttgagagtgactatgggagattttaactcattttccactgaaaccattaataatatgccttcattacaaatgacgggaaaaactcaatatataaaaaaaatgtatgcagataaatgtgatgaactggctaaagaaggattagattttacgaaaaccatgtgtactgttggaatgacaggaatgtcttttaatgttcttgcaattgttattgtattaattttaggtgctgttgatgtttctaataatttgatttctgttggtttgttgtttagtatgactatttatgtgcaaagattatatagtcctatagtatcaataggaaatatgtttgttaaaataaaaaatttctttcctttattagataacatttataatgtaatgtttaatgaaaaaaatataatcaagggagattataaacacagcagcgagcttatgggaaatatttcttttgataatgtatggtttggttataacaatgaaagatttatattgaaaggatttaccgaaacgtttaatagaggagaaatcattggtattgtagggaacaatggaagcggaaaaactacattagtcagattgctgactaaattgtgtactgtcgaacgtggcaaaattgagattgatggaattgatattaacacatttgatatggaatatttgcagacgcaaataggcgttatgactcaaaatagctatttgctggctgaagagtttaataatattctaaagagtgaaaaagaattaaataaaatgaaaaaatttttggaagaaatgaacttttacgaatcaggaaacagtatattaaaaggtaattttgaagtaaaagaaaataatttaaatatatcaggaggggaggctcaaaaattagctctttataagctttatttggataataagccgatttgtgttctagacgagccgactgctgccttggattctaatagtgaagagaagatgatagagtttattaaaaatcattttaaagaaaaaactgtaattattataactcataaaccacaaattttaaaaatttgtaatcggataataaaattggaattgcatgaagggggtaagatgacagtatgaaattaagtatttgggtaactaagacatgtaatatggcctgtagttattgctatgaagaaggacttataagagaggatactggtgtttgcgaaattgattatatcgaaaaaacaatagagtttattaatacaatgtgttataagaccgcctctaaaaaaatattcattaaattttttggtggagaacccttaattaagtttccttttattaaaaaatttgttgagattgcaaatgaaaaaattgatgacaaaatcactcctttttattctataacaactaatggaacattaatgacggatgatatgcttatttggttaaaaaaaaataatgtggaatgtgcattaagtatagacggtgatgaagagatatatagcataaatagacgatataaaaaccgatcatcagcgtggcgcgatgtcgatgatctcattccgcgattgtttgatgcaagtttaaaattgtctgcgagagtgacctataattcaaaaactgtttcaaaacttagtagtagttgtgaatatttgataaatcgtggctttacagtgttgaaagttgtaccagattatttcgattctgaatggagtgacaagtcattggagattctcgaaggacaattaagagaaatagataagataagaaatataagaaagaatgcatatataaacctagatgatgatgaattgtttatcggtagacggggctgcgcgggaggttatagcatgtttagtattgatttgggggggaatgtttatccttgtacatatgttatggatgataaacaatttcttttaggaaatatagaaaacgtttcagaaattgaaccgcgatatacagatggaacgtctttgaatagggaagattgtgttggatgcagatattttaaatgttgcaaaagtgctagctgtttatatggaaattataaaatgacagggtacttgaataaaactaattctttcttttgtggatatagaaagatattgtatcgaataaatgaggaaaagttatgaaaaatatcaatagtatatttttttcgaagtatacgagagtattaataaatggtaatgaatgtattgttggcaatattgcttttgatggaagatggatcaaaatgtcgcattctctttataaagatttggtgcaaaagtctcaaaataatatatctttactatctgaaaaagaaaaaaaatatataaatgcatttcgggaagtaggtatttgcattgataatgcagaaaaggatgagttacaattatatccttcggatataaccattgagataacaactcagtgtaatttggcatgtaaacattgctcgtattcctttggtgggaaaaaatatagagaaatgccaattgatatgataaaagctatttcaaaatggtcggaagacaataaagtgaaaagaatattattaacaggcggtgagccattttgccggaaagatatagtcgatgtatgtaaagtgattaagcagaattttactgggtcattagaaataattacaaacggaactttggtaactgatgagtacatcgagcttataatgaggtatattcatgctttacatattagtttagatggatatgatgaaaacagtgtgagcatgatacggggaaagggtgtatataataaagttattgcattaattaataaactgaagatgtgtgggtatgaaagaattactttatcatgtgtaagtgttggcgatgataattctgaaataataaagttcaaagagttatctgaacgattacatattaagccggttattagacagcttaatataaaaggacgggcagaagaaaattttgcggaggatcctatggaattgcgtattatgcataatctgactgaaaaaggacttacatttaaatgtttatgtaaccatcaatatcgttctatttttattaatacttatggaatagtgttttcatgtgctgcattaagagaggaagaattaggaattggaagttttatagtttcggaacacaagatacatatagacggtttgtttgcaaaacctatagttgacaaaatcgctccatgtcaaaattgtaatgtacggtatttttgtgcggatacttgtatttcaagaaataatgtgatatactcaaacaataaaaaacgtgttgagaggtgtcatattaaaaagaataaattggaaaaaattgtgtggcacactgataatgatttgtaatttaatttacaaataaaattttaaagaagggaggagttatcatgggaaacaaagaaaaagaacttgaagttgaaatcaaaggttatggatgtgacgatgattgcgaacagtattttgagaaaacggcatcaaaagattgtggctggaaagaaactgataatacttggccactgtggtagaaagtatcaggtaaacatgtaaatgagtaagaaatgggtgccctagaagtctttgtaaaaccaatattatacaagccctagaacatttgataaggtgtattttggggttgtagtatgtggtgcgagagacttttagggcattctttttaattagtgagtaggtgtaaataacttcaatgaaaattgctgtgttagatagtgggtttgattttagtcaaccattacagaataaaattactaatataaatttcacagatgaaactaacaaagatgaaaacggtcatggtacatgtattataaaattaattgattcaattagttctggtttggaattgtatagtataaaaatattggatagaactggaaaagggaagctgtcgtctttaaaagtggcactacttgaagcgttaaacagtgacgttaatattattaatttaagtttaggaattgaagcatttattaaagattcggagttagaaattcttttagataaatgtctgtctcaaggaataataatagttacatcagaatcaaataatggaaaaataaattatctttcttgtaataatagaataattagtgtccaaggtaaacaaaataatcttgttaccagtaacaatgttatttatattaataattctccaagaattataccatggttgggatcgtcttatgttttaagtggagcaaatagttttttgactccatttattataaaaaaaatatatgaattattgcagaatcatgtaagtatacaaaatttaaaaaaatgtttaatgcagcaaagttttatatttaatagtaataaaaaattcagagacaatcaataattaatgctaaattaatgaaaagtattgaggaagaaatttctatttggaatttatatgatgaaaataaagcatttaaaatcgcccaggctactccacggaatataacagcacttgttaggataattgaagaaaaaactcaacaatcatatatttatgattccttttggatgccagatttagcttatttagaaaattttgttaacaaaataggatctatacttcactaataatacaatgaaaggtgtaaatatgaacgaaattaaactggataatatatgcttttcggataatacaagaattttaaatcactataatgaaatagttattggtaatgtgagagagtgtggtttatggataaaaattctaactaaagactttgaaaaaataaaaacatacataggactagaaaatggttttgagctgttaatgcggaatacggataatgcacggaagcaatattatattgagattattaaggctttagcaaaaataaaagtgataaaacgtaaagactggagtgaaaacaagaaaactatagaacgattagacattgaattaactacaaaatgtaatttgagatgtaagcattgttctggcgagtatggtgagcaagataaatcttcaatgccacaagagatgtttcatagaatcatacattgggccgcagaaaataatatatcctcagtaacattaagtggtggtgaaattttttgtttgtctaatatttcaaaatatttagaatatgcaagaaagaattttatggggcgtattgatattatttcaaatgctactttaatttatcctgaacatattagtatattaaagtcatgtgtggatgaaattagtattagtttagatggatatgacaagaatagcgtagatttcatacgaggacaaggggtgtttgataaagttattgagactataattttgctaaaaaataataaaattgataacatttcactttctatggttctaacaagtaataataaaaatcatgtaactgacttcaaagaactttgtaataaatttgaagtaaagcctattctaagaacactctctgtaaagggaagagctttaaagttttatgatgacttaattaatgataacgaaaaaggaaaagaagataatatatctaagagaattaacatgttagccatgtgtaatgctggaagtcaaatactttctattaatgcaagtggtaaagtgactttgtgttcagctatggaagagtcaaatgttattttgggagatattgatgaactggatataatttttcatgatgttaaacgaattaatacgatttgtgttgtagatacggttacaccatgtaatgaatgcgatgttagatatttttgttcttctatgtgtcatgcagtaaacacaaatatttacaataataatcagttgaaagaaaaacggtgtgagcaatataaaaatctcttggaaaaacatgtatgggggatttgaaatatattgtgagtactaagtttagcagctgtcaggcaaggaaaagaatgcaatgataaaaatcttaaatagtattaaagaattacgttagaaatagcctttgcagaaaggctattttttatgtatgcgcgccatgggcgcgctctaatgggtgaaaggtcccgaatatgcccaggtagtgggaaatgtatagctgaacagcaagggtgttcaccgtgaggtaaaatctgaaggaagtcgttggcaaatctctggtccgacggacagaaaccgcatacaaggctaggctacgagagataagttggcataaagcaacgaagtctaataactaccacatttgtggtagcagagtaaatgcggtggatgaataaattaaagattgcagtattagataatggtgtagacgaaaaattgcttgcatcatgtggattacccgatataattcagcagaacaaaggaaatatcagtgatgaggaggatttgtttctgcatgggacaaattgtgccatgatcatagggcttaattgtgccgacgcagaattatacagttataaactgcttgataatacaggaaaaggaaatgtggatgatctgaaatcagcgtttgactggtgtctgatgaacaatataagacttgtcaatctgagttttggaactacacatgaatattccagatggttttacatcagccgtccggtgatatggaaatcactttttagatccgcttttgtgcataccgaatcataatttctgctgagacatttgtaaagactgctacgcaccgcagatgcggcaaggtcttgacaaatatcccaacagaaatggataagtcatcaagcacaaaataggcgatttccgagtaccggaactctgatttccaaatttccggaagtgcgatttcatcgcacaagaatattcaacacattttaaggacaaaggaataattcggcagttggtaaatcaatatgccaataagggacttatcataattgcggcaactgctaatagtgggtatacggcttttccggcatccttttcaaatgttatcggagtaaaagcaaaagatacatttaacattgatgcggaaggtttgcgggataaaggtgtggattttgcagctccatcggaacacaaaatctggtttggaggaaacgatataacgcttcagaaaagtaacagctatgcggcaccttatgtaacagcaatggctggaaggttaatgatggaacagtcatggatcaataatgtatggcagattaagaagcatttataccagaaattcaggggaaaatgtgtacaatatattccggattggatagaaaaaggatggattgccggaaaggtattaaagagtaaggaagaggtttattttgaggtagctgcaaaggaagaagcagacactgtaattttgtatgataaaaatgagtttaatgaatacagggagaagcacattgtgtatcttggcaatgaaatagcagagcagccggatacacagtgctttttctggagcagaagaaacagaaaagaacagatcttatgttcaaggataaagaaggagaatattaatatacctgtcatacttttaaaaagtggtaaagaacaggatcagatatggtggcttacggaattaagaaagagttttgaagcggagggctataatgcatatgctatttccactgaacaggagagcgtattgtatgatttagaatatatcccttttgctgttgatgaaaatataagtaataagattggtgatttcctgtattggcagacttattacaaccagtctgatttgattatttgtggaatacaggaaaaagaaagtatcggtgtggaagccgatatatttgtaagaatagaaaatgggaagaagcagacaggaatacaaatttattgcgacaaaataaaaaaggcgcagatgtgttttggaaccctcggagagcagcagataaaggaagtatatgattgtctgcttacaatcctgacggaggatgaagatggggaataaagaagcagtaaagaaactgctgggaatgttaaaggggtatagaaaaataattgctctgattattgcatgtctgctcatttcaacaggattgaatatgtgtatcccgttactaagcagggggattatggattatggtttcataggcggagataaagaactgcttataaaacaggtaataggttcactgcttatctatatgatgatagcagttattgatattataaaagaaaagaagcgggtagatatatctgcgaatatacaatattctttatcggaacagtcatttcaacgtctgatgaggataaaagcaaactatttcagcagtaaaaattatgcggaaatcctaaataacataaatatagatataggaaatatgacttctgttgcagatgagggtgtgttttttgttgtcactcaggcattcagtatggtaggtggaattatcggactttttatcttagattacagaatgacactcatggtacttctttttattccggtaaaagcggttattatgaaacattttgcaaagaagcgaaaaagaatcatggacgagtttattacagaaagcgaaaaatatgccggatggtttggagatactgttggcggtgtaagggaagtaaagctttttggaatacaggaaaataagagagccgaatttgctgacagacagctttctgtaatcaataaacagaaaaagatgaatatgcttgcccagtggaacggcataacggataacattatcgtacatctgctgaccagcttgatatatattattggcgcaaatcttgtttttgatatgcagctttcagtaggcagtgtgtttgcgtttattacatatagtgcgtatgtgacaggacctatttcagcaatactcaatatcgggtatcttttgtcaggaattattccttcaacaaagcggtattatgagtttatggcacttgaagaagaaaaggaaaatgaggagggcatgaccgagccttcttcggtgatctggaattacagaatctttctttttcatatgaaaaggataaagcggtactgtccgatattaatattgcttttccaaagggaagtaaaacggtgctgattggtcggaatggttcgggaaaaagtacactgataagtctgttgctgcaattataccaacctacaggcggaaaaataacattaaatggtatagatatttcggagtttgttttgagagaatacagaaatatggtatctgtagtaagccaggagatctatctgttcaattcatctatcagggataatatctgtatgtataaaaatatagatgataagacaattatggaagcctgtaaagatagtggacttgctgattttatttctgaggtgtcattggattatgtggtaggacagaatggggcaatgctttccggaggacagaaacagaaaattgcactggcaagggcattggtgcataacagtccggttattatatttgatgaagccacatctaatacagatgtgtattctgaacatcagattaacggactgctccatacgaaactgaaagaaaagacggtcataatcattacccacaaacaggagatattaaaagaagcagatcagattatcatgctgaaagatggtgctgttgttggaagtggagtctatgatgatttgtcaaaagataatctggaatttaaaaatattgaataatacattgccatgaattgacaggagatagtaaaatctgcaaagtattacacgaaaatggcaaatggttacagattgccagacaccataataatttctgatataatgcgataagtcagaaaggatgatggggctatggggaaacgagagcacatatacaaaattattgcagagaatatcagaaaagaacgaagaaggcttggaattacgcaggcagagcttgcagaacgggcggatgtatcattggatactatcaaaagtgttgaaaatggcagaagggcaatgagtcttgatacatatttgaatattgttcatgcattggagtcatcgcctatggttctgatgagccagcagcaccctaagaagcacattgagcgttttgcatttatgatgaatcggtgcgacgaaagagaaatagaatttgcattacatatgattgaacaaatattaagaggacaggaagattatctgagtgaatagacgggtagttatcctgtcctttgtctatgactcttttgcaaatttttcagcgagatggtatatgatttcttcaatggtgggagtatcattttcacatggaaagtctgtccagaagcgttgcatttgtggatcagggctttttaaagcaatggaaactgcccgcccaatttcctgttggacttcttcttttgtgattccttctttttcggcaatgatttctaaatatttatcaacagagtatgtgcttttatcattcatagtgttgttgtgaatcctttctgagaagggtatctacgggcaaattgtcaggtgcttgaattgtcccggttgaataccataaaagtaaaacagataatccgttctatattacataataaccttgagagctgttttctatgcagcttatggctattttctattctatcatatacatacagtacggtgcatacacgcaccatatcattataggacactcttgcgtagaatacaaggaggaggtctttgtaatgatagtatatgacaggttatggatcacactcaagaagaaaaatattagccagtatgcactaattaaagattatggaatagataaagcacagttacagcgattgcgaaagaatatggtcgtaaaaacggtaatccttaacagattatgttccatacttgattgtaagatagaggacatcatggagtttgtgccggatgaggatattaagtaaagagatatttccaaaatgtaatgagagtttggaaatatctcttttttaatccgcaaatatttatattcttggtattaaggtgtacaatattccacctgaaatagctggtttagtcactcttacaaaagattcgcttacggtacaataaatatagcttaagcaaatatataaggtgccggaaaagagtggaaggtgtactacgatattgttaatagtggagaaagaataaaagagttgcgtgcggcaagaagaatgacaagacagcagcttgccgagcagattggattgtcagtggacgctctgcggaaaattgaagctggtgtaaatggagcaaaaatagatacgctgattagtattgctgaattgtttcatataacgttggattatcttgtgtgtgggtgtgaaagaaaggtagaagtcgatgatctgctggttggtctgaaggagaaggaagtacagtttatccggaatatggtattaaatgccgttgacaatatgaaacttctgacagaataaaaaagtcggattgcatttttgatgatgcagtccggctttttttataaggatttggaacaggtgggagtgttactcttagttcaaaagagtgtcggttactgtagaagatgcgtggtgtcagttatactctgttcaggttctgagaaaagaaccgttgaatattgaaaacagaataggacacgcatattccacgagcttatatcgccttgtctatgacagggtggcagaatcccatttcgtgcgatgactatcctcagagctgtagccgattatgagaaacgtaacagcaggagcctttaaggataagagcagagggttgtgcctaccgggttagcagccggaggtaatgagataataagtgcacctgaatttcagcgaaatgcattttcagagagtggctactttcgtaagtccagatgggcaggaaactacgaagtgtttgtggctggcaaaggatatgttacccgatacggggaaggttgagaaaccgggaagatagtattttatcttcccacacaaactgatttgcagtaaccagcagacaacaacggggcttataagtgcagagagcattggcaggtcagtttatgtgaggagataaagtgtgcacaggatatcaaatcaaaataaaaacaggaatggagattttaaaatgaataaagcagttatatattttggagcaacaggaaatgaggcagcggatcagatggtaatgcaggttcttgaggagtattgcgctgtgaatggatatgaggtggttgcagttatttcagagaacgcaagaccggagggaatgacatttcctatgaagtttgcctttgtcggtatggcagaagtagaagatgttgatgtggttgttacttttatgagtgatatggtgggcgattgtgaagaaacaattatggataacatcattatgcttggagagcatggcattacggttgagacagcaaacgatgatatggctggatattatcagaagatggagcaggcagggcaaaaggaagataacggcattgtttcacttgctgattttatggcagtatttttcagacgtctcagagccaacagataggaggttttatgagtaagtgttgtgttatctgtgtaggcaggaatgccgacagagccgcagacaggatagaagcatatgctaagaaagcggattttgagattgtagaaacaatctttaaagatacgaagtctgtggaaagacttaaattttatatcgaaagagattccattatcagtattctggtaagcagtatctatgatatttcatcggacaaagatgtggtaaagggtattatggagcttgcagcggagcacggtatcagtattaatgacgagagcaggggctatgaacctgctctcatctcgtttgaggaggataatgccggataaaaaggaattaagcatagtgacattttcatcagaaaccgtggtgtttgatgggaaaggagacagagttgttgcctgccctacggaacaggaagctgtcgaatatatccgtgggcaggaaataccagttgacagacaaggaagtgaatattatgagtgaaataagacggggcgatatctggatggttgattttggagtaccggaagatgagaatgaccacaagctgcacggtatcagaccagtagtgattgtgagcaatgacagtgcaaacagacatagcacggtattccatgcagtaccgcttacaagtaagattcataaaaagacatatctgccaacacatatttttatcagttcgtttaaggctgttggattaagaacgaacagtatcgctcagtgtgagcagttatgtgatgtgaaagatacggacctgatagaaaaaatcgggaaagtaagcaaaaaccagttaagacagataacaaaaggtatgcagatccagttgggtatgagtacaaaacataataatccaatcgcataaattccagccggggcgaaagctccggtgttacatagccgtcagcatatctggtggcttaatttgattggagggataggatgacagttgaacagttggacaaaatatcggcacagagattagaagatgtggatattgatacattggtggaagtaaacagcataaagtacgctgacggaatgcctgtggaaaagaaggttgcgggaatgattgcaaagacaggtaatccgtatttccgcagatcaggaaagagcaaaattaagatttcattttctgataacggggaaagcctgaaagacaattatattgctatgcttgccaatgtatagagcagtcagccaaaattaggggtggaaattcagatggatttgtgatatcattacagacaaataaggacatctaacccgaaagggtatcaatttcatatttatgtttccattcctcttgatttgggacttctaacttagaaaatcgaaggagtggtggacatgaacaattctaaaagaatttacagagcagccatctatgttagattatctaaggaagatggcgatcttgatgatgtgagaaaagctgaaagtaacagtatctcaaatcagaaatccctgatacttaattatttaaaagacaaagaagatattgaaatagtatcaatccgtgaggatgacggctattcaggggcaacttttgaccgtccggcatttaaacttatgatgcaggatgtgaaagacggtattatagactgtatcgttgtaaaagatctttcgaggtttgcaagagagtatatcgacgcagggagatacattgagcggatgtttcctgcaatggggatacgatttatagcgatcaatgatgcctatgacagtgcagatacacaggcacagggaaacgagataatcattccgtttaagaatcttatcaatgacgcttattgcagggatatttccataaaaatccgaagccaccttgaaacaaagagacagaacggagaatttgtaggaaattactgtgtctatggctacaagaaatctgagattgaccataatgtgattgttcctgacgaatatgctggtccggtggttcaggatattttccactggataaagaacggaatgagccttgatgccataagtgacaagctgaatgctcttggtattctctcacctatggcatataagctcagcaagggagagaattataagacagcatttcagaagaaagacgagctgttgtggactcctgttgctgtaaggcgtattgcaacgaatattatttatacaggaacgcttgtacagggcaaaatcacaacacctaaccataaggttaaaacaaggatattaaagccacaggagaaatgggcagtatgccacaacaatcacgaggcactggtatctttaagaacattccagattgtacagcgtctgttgtcagtggatatgagaatggcaccggggaaagactctatctatcttttatccggaatagcagtatgtgccgattgtggagcacttatgacacgaaaggtgtctacggtaaatgggaaaaagtatgtttactatatgtgttccaataacaagaagaataagaagtgcagctcccacaggataaaagaggcagacttggaaagccgtgtatttgataccttgagggaaatgacagcaacacttctggacgctgatgaagtgataaaggaagctggcaacaatgccaatttcagaatagaccagaaaaagacaaaagagaggatcagtgcaaaagagaaagagataaccaaatataatcagatgcttgtttcactttatgaggactacaaagatggaatcgttgataaatcagactttgcgattatcaaggagagctttgaagtaaaaaggtctgaagcggaaaaggcaatcgacaggttacagaaagaagcagaaaacattgctgccggaattgaaagagataccgagtggctggaagaacacaggaaatggaaaacaatgccttctcttacccgtaatgtggtagtgagccttatacagtccgtaaaggtatatgagggcggtgatatagaaatcgtactggattgtgacgatgaatacaggaaaatcgttgcaagagccggggagctggaaaaacagcaggatacggaaaggctggtggtctaaatggcaaggaagtcaagaacacagccgaaacaatcaccggatacactgaatgtattatccaaagtgtataaaactgccatatatgtgagattgtctgcggaaaaagatgaaacgagagacagaaaaaccctgatcaatcagagaaatctcattaagaactttgtggatcagcagatggatatggaaatccatgacatctatatggatgatgaaatttccggtacaacattcgacagaccggaatttgagcgtatgatgtcagatatgagggcaggaaggatcaactgcattgtcgtaaaggatttgtcccgcttgggtagagattacattgaaacgggcaatctggtagagcgtgtattcccgatgatgaatatccgctttgtagcgattacggataattatgattcctcaaagaaagacgcagaccttatggttgcggtcacgaatatagccaatgatctgtatgctaaggatatttcaaagaaaatatcttccagtaagcaggaagcgatggaaaaaggtattccagttggcagagtgacttatgggtataaggtggttcttgatgaaaacaaagtcagggtaatggttgaggataaggaagccgcagatgttgtaaggtggatttttaatgaggcagaaaaaggtacactgcattctgtgatagcggcagaactgaatgcgaagcatatccttacacctgcccagtacaaagtaaggcataatatagagaaacttgaaaagctgcgtggagttaagtggactgttgatacattgtcacagattttaaagaatgaagtctatattggaagatatgtgacaggtaaagacagggtatgcttgtacagacacgaaaagaggcatactaccaataaagatgagtggtatgtttttgaaaatcatcatattgcacttatcacaaaggaacagttctatgcggtgcagaagaacaaaagaaaggtaataaagccagcaaaaaagcagaccgtgaatatgctgaaaggcaaaatcacctgcggctgttgtggaagcagtatccatatccaccctgagaaatatggaaaggtttatatgtgtacgcatagaaaaagatatggaaaggacagttgcaactgcctgcctgtaaaggtagacgatatatatgcagcggtgcttgctgttataaaggagcagatacaggtctttattgacagggaaaaaatattaaaggaacatcacaatgacagcagtgtaatcagacaggaacaggtatatacggaagctgtgaataagtgtgtcaaggaaatggacagacttatggaattaaagagcggtctgtatgctgattacacggaagatttgcttgatgaaaaggaatatctgcaactgaacagggagtattcacagcgtattgagaaattgaagatacaggctgatgaatacaggcaggcggcaagtcagtatgaaagtgctgaaaagaccgttgcccagttaaaagctgaaatgctccgttttaaaggaaaacgcaagttgacgcaggaaatggtcgatttgtttgttgcacaggtacgcatatacgaaaacaagaatcttgagatcgttttgaactatgaagatgaactgaaaaaattcgcagaactgaatatggaaagagaggcaggataatggctgagaaaagaaaattagccttttatatccgtctctcggatgcggatgaggaggtaaaagaaggaacaaaagacgaaagtaacagtattacaggacagagaaaactcttgtatgcgtatatcaagaaaacagaggaatttgcaggttttgaggtactggaatactttgatgacggatattcgggaacaatgttcaataacagggcagaattccaaaggctcatacaggacgcagagcttggaagatttgaatgtatcatagtaaaagacttttcacgatttggaagggattaccttgaagtaggcaactatctggagtttgtattccctgcaatgggaatgaggtttatttctgtcaacgataattatgacagtgacagaaactttggtgttaccggaggaatggatgtagcttataagaatctgatttaccagctttacagtatggatttatcaagaaaggtaaagagtgccagaaggacaagaaatctgagcggcgaatacacggcatcatttgtctgctatggatacaagaaagatccagacgataagcataagctgataatagatgaagaagctgcaaaggttgttgtggagatattttcactgatcattgcaggatataatgcaagtgaggttgcccgcatattaaatgagagaaaaatcccgacaagagttcaaaaccagtggaagaatggaatcaattatgttccggttcataataaaggggattatatgtgggataattcagaagttatagcgattgtccagaatgagcagtacaaaggaataatgatccagaataaatgtgaaactgttggttttggagataataagaaggttcgcaaacgaaataaagaggactggtctgttgtagaaggtgcaataccaagaatagtaagcgatgaaatgtttgatgaagtcaataaaatgctacgggttgaagccagagggattgaaaagagtacaaagaaacgtaagaaaaatctttttatctgcccctattgtgggagaaagctgatgaattccagtgcagtatgtacaccgaagctcctctgtccaaaacgcaggatggtaaggactggcgaatgtcagcagatttttatgctgaagtcagaagcacaggacaaggtgctggaaatcacaaaggaaatctgtagaacacttatacaggaagaagaacttaaaaaggcatcaaaggataaaaggaaggtgacaagcgatgagtatttgattagtgagcttaaagcggagtatgacagaatatcaaacagcacagtttcttgttatcagtcatacagagagggaaagtacacaaaagaagaatatgtgcagttaagaaaaacaaaccaagagctgttagctgatctggagaatcagatatcagatttgcaggagaaagttgcaaatcaggagcctgacgcagaggagaagatagaacagctaacccagtatagtatgctggagcagtatgacggagatgtactttcaaacataattgataaggtgctcatttacaacgacaaagatatagaagttgtgtttaagggtgagaactttatccgaaatgcagtgtagtaaacaaaatgagtaatatagaaagccagtagtgaaaaagctgctggcttcttctatgggtaataacgaaaaggttaatagtaataaactattctgtactttaaaaatcagtaagggtttgatagaatatgtacagaaaaaaataaaattttttttgtcccagtcttgacagatgcaggattcccgatctggtggtacgttgcgccgacgatcatcaacacgttcctggagagctatgatttttccggaaagacggtgatcccgtttgcaacatctggcggaagcggtatgggaaaaacagaagcagtgctgcatgcactctgcccggacagcgtgaactggaagagcggtaagatgttgaacggatatgacagagcgcagatggaggcgtgggtcagaacactcgcctagttctgtgaaaaataagaaagaccggcgatttgtgtcgcaataagacgagcggtttttgttgtacggaagaatcgatacacctataatataagttaaggaattacaatataggagggtgtatggaaaaggtacgttatatgatttccgatgcggcaaatatcgtccacgtcgaatcacatgtgttacgttactgggaagatgaactggaactgaatattccgcgcaatgagatgggacaccggtattatacgaaggaaaacattgcggaatttcagagaatcaaggaactaaaggaacagggctatcagttgaaggcgatacgcatgattgtacataacggaccgatcgaggggctgacggcagaagcaccgattcccgtgggacaggcaccgctttctgcgggagcggccgctgcaatcccgcagccggtacaaccggtcgcggcacagccggcagcagtggtacagccggtgcagcaatccgtgcagccggtgcagtccgctgcaccccagcagcttccggtaaaaacgaccgccgagagcccgcagagtattctaaacaatacggataagatggcacagttcacagaactgatgaccgagatagtgggaaaagcgcttgccgccaacaatgaagaactggggcaaagcatcagcgaggaggtaggaaaacaggtgatcaaggagatgaattacctcatgcgggagcgggaagaggcagaggaggaccgcttccgcaggctggatgctgcgatccgtggaaatatccgcaaaaaggacgaacagaaagaaaagaaactctggaaaaagaaaaagccgtcacaagcgtgacggctttttgctatgtacgaaagattaaccctcgctgatagctcctgtaggacaaactcctgcacatgttccgcagctaacgcaggaacctgcatcgattacgaactggctgtctccctgagaaatagctcctactggacattccggctcgcatgttccacagcttacacaagaatcagaaataacgtatgccattttaaattccctccttaatttgtaatcaaaacccggctacccttatagataacctttaagacattctaatacaaaaatacacggctttcaagtcaaaaaagccgtgtacttaaattagcacataatgctgttacgaaatatattccatgctggagcttctgctagaatgttgaaaaatgatacagtgtcttggaacggaacggctcatccggtgtcagcacgatgctcgggaaattgtcatggttgatcgcgtccggaaaatgctgtgtctcgagacacacgctcgtatggcaggcatattgcgtaccgttcttgccggtgacctcgatcggctggtttgccacatacagctgcatacccggctgatcggtaaagcatgtcatgcggataccgctctcctttgactggagaaccgctgcctcacggaatccggtgccattgatgacgaaattgtgatcgtaggtgccgaacttgtgatactgctcgtagtcggaatccatcagttttccgatggtgtgcatggagcggaaatcaaacggcgttccctctaccggaaggaatctgccggtcggtgcctgtgagtcatcgagctctgtgatctgatcggcgtcaatgaaaagctcgtgggataaaacctcactggagccttcaccgttcagattgaaatagccgtggctggtaacgtttaacagcgtatccgcatccgtggaagcttcgtagagaagggacagctcattgtcctccgaccagccgtaggttacggaaagtgtgagattgcccggataaccttcctcgccgtcgtaggaattcatggttaaaatgagtttgtcatccttgatctttgcgtcccagggcttggaagcgtagccgatcagtccgccgtgcagatggttggagccgttgttgatggcaagctggtattccttgccatccagacagaaatgaccgtccttgatacgattggcaacacggccgacaactgcgccgaggctggcgttgtcgcgcgcgtaatcttccatggaatcgaaaccgaggcagacgtccgtcatttttccgtcgcggtccggaaccacgatctttacgagacggcagccgaaattgatgacttccacataagcgccgtttgcgttctccatatggtatatataaatattttctcctgtgtttaatgtgccaaaatctgactttgtaatcttcataggaaactcctttccatttatatcaggacaaacctaacgcagataattatgccacatttgcaaaaacatggcaagtgaattgccctattttcggaagaatgcccatagcgggcgaaatgtcaaacttgcctaaatcgtgaaattatgcaataatgttcacgaaagcgaagcggtcatgcacgcactgtaaagcaggtcaggagacagtgcatatgacggccgcaaaggcacaacagttgagaggcgaataatatgcagacaaaggttgttaagatagattctgcgaatatagacgatgcagccatgaaagaggcgtgtgatctgatccgcgcgggagagctggtggcatttccgacggagacggtatacggactgggggcggatgcgctgcacccggaggcatcgaaaaagatttatgcggcgaagggaagaccttcggataatccgctgattgtacatatttcaaagtttgaagatctggtatcgatcgcgagggaggtaccgccgcaggcgaagaagcttgcggacgcgttctggccgggaccgcttaccatgatcgtatggaaaaatgacagagtcccttatgagaccacgggcgggatggataccgtggcaatccgtatgccgaagcatccggtagcgctccggctgatcgaggggagcggatgcctgattgcagcgccaagcgctaacacatccggcaagccgagccctaccgaggcgtcccacgtggcgcttgatatggacggcagaataccgatgattctggacggagggccggtcggcatcgggatcgagtcgacgatcgttgatctgagcgagtcgacgccgatgatcctgcgcccgggatatatcacacaggagatgctgcaggaggttctcggcgagaaagtctgcatggatccgggaattattgcgtcggattccaccagaaagccgaaagcgcccggcatgaagtacaagcattatgcgcccaaggcggatcttgtgctggtggagggcgagacggacaaggtcgttgccagaatcaatgagctggtcagagaaaagcagcagctcggacagaaagtcggagtgatcgctacggatgagacgtttttacgctacgaggcggatcacgttgtcagcatcggcgccagggaagatgaggatgccattgccagacacctgtataagatcctgcgcgagttcgacgactggaatgtggatgcgatctactcggagagttttgccacaccgcgcatcggtcaggcaattatgaaccgtctgctgaaggcggcggggcatcaggtgattccggtatagctacatcagggagagggcagacatttctatgagacaatataatcgaatcatatttgttgcagaaagcggcacctgcagagcacctatggctgcaggaattctgcaggaatgcaatttaaaacatccggtggaaatacttgccaggggactggtggttttatttccggaaccattgaatcagaaggcggaaactgttatgataagcaatggtatcaatatggatggattcatgtccacccagttgacggaggaggatttttcggaggatgcgctcgttttagtcatggaacacagccagagagagaagattctggaaaagtacgggcacgccgatccggagaatgtctatgttcttacggaactggtaggagacgaacttgagatcatcgatccctacggggggacgcttcaggcgtacggactctgctatgagacgatgcgcaagacgatcttaaagcttgtgaacctattgaatgaaagtgaagataacggcacagactaggctctgtgtaagaagggaaggtacaaaaaatgtcaaaagtagtagttatggatcacccgctgattcagcacaagattggaattatccgcagggaggagaccggttctaaggatttccgtacactggtcagcgagattgcaatgctgatgtgctacgaggcaaccagagacttaaagcttacagatgtggagattaacacgccgatctgcaagaccacggtcaaagaattaaagggcaaaaagcttgccgttgtcccgatcttacgcgccggactcggcatggtggacggtatgctcaacatgattccggcagccaaggtcggacatattggattataccgtgatcctgagacattagagccggtagaatattactgcaagcttccggcagactgcgcaaacagagaggtgtttgtggtagacccgatgcttgcgacaggaggatcttcggttgcggcgattcagatgttaaaggataaaggcgtaaaaaatatccgcctgatgtgcattatcgcagcaccggaaggtgtgaaaaagatgcaggaggcacatccggatgtggatatctacatcggcgcgctcgacgatcatctgaacgagcacggctacattgtaccgggactcggagatgcgggagatcgtattttcggcacgaaatagaatctgtttgatgcggcggacgcaggtgggagtgataggaacatgagcggaaaacgtacagattatatcagctgggatgaatactttatgggcgttgcgaccttgtcggggatgcgctccaaagatccgaatacacaggtgggagcctgcattgtcagtgaggagcacaagattctttccatgggatacaatggctttccgacgggctgttcggatgacgacttcccgtgggcgcgcgagggcgaaccgcttgagaacaagtatttctatacgacgcacagcgaactgaatgcgattttaaattaccgcgggggaagccttgagggcgcgaccatgtatgtcacgctgtttccgtgcaacgaatgtgccaaggcaatcatccaggcaggcatcaagcggctggtttacgacagcgacaagtataacgggacgccgtcaaccatcgcgtcgcggaagatgctctctgccgcaggggtggatatacagaaatacgaacataccggcagaaccgtcacgattcagctgtagaaaaaggacttttggagccgccagagatggcggctcctttttgtcattaggctttagcctgctgaatgcgtgtttacgagtttctcaacagagaaacgaagtacgcatgaagcaaaaacccacctgctatgcgggtggagtcaaatcgttatacagaaaaacacctttccgttacaatagagttgttcagtcactattgcaagaaaggaaaggtgttttatggcgaataagtctaatgatctcgcccatacaaaatggatgtgtaaataccatattgtatttactcctaagtatagacgaaaaattatttataatcaattaaaagaggatatacgtgatattctgaaacagttatgtgcatataagggcgtggagattattgaagggcatctcatgcctgaccatattcatatgctagtaagtattccgccaaagatgagcgtgtcgagttttatgggatatttaaagggaaagtcagcgcttatgatttttgacagacatgcaaatctcaaatataaatttggaaacagacatttctggtcagagggatattatgtcagcaccgtaggattaaatgaaacgacaataaaaaagtatattcaagatcaagaaaagtacgatattatgcaagataaattaagtgtgaaggagtacgaagacccttttaagggttaagtcgaagtagtacaaacgcccattcatgggcataagcaacgcgtcaagtgcaatagtgacttgaacgaagagaaagtctagggcgccttgagacgctgtcgggtaccaaggggttacacccagcgtcccgagccaccctttttaagggtggcggcgactgtcagtaaattccagaatatccatttatttttaaaacagtttctttgcgtcggttgatttttctttacaaatcttttatacttataaaagaatttgttatgggaaaaataataggcaatggttgcagcagagactgcggtacggtgaggatttatatgaaaaatcagcgaaaggttttccagtctttgacactgattctgcagtttggactgaacatgatcgtgccgatcgtgatgtgcacgctgctcggtgcgtggctggggaaaaaatacggaatgcccatcataacagtgccgttgtttatcatgggcgcacttgccggatttaataatatatttaagatggctaagaagatctacggacagggagatgaggggaagcgggatcatgttgagaagactaaatgatgcattgcccggtcttgttctgggaattattgtatatggggcggcggtttttctggcgggaatctggttcgtgccggacaagctgcgatttactaccggacttgccataggcattgcccttgcctgcgggatggcggtcaatatggcggtggttctgcgggatgcggttgagatctacggggaggcgaaagcccggtcgaagattatcgcccggtccattaccaggtatctggtggtcgtcattgtgtttttcgtgatgatgaagtgggagcttggcagtctgccggcagcatttattggtgttttgggattgaagatatcagcgtatctgcagccccttgcacatagattcatttcaaagcttggaggaagaggtgatgtgccttcggacagcagagaaaatgaagctctataaggaggtgaaattgtgaataacgcaattttgatgtcttctggtgccgataatattgacttcatgatacatgggattttttcctatgagatctttggtcatacggtctggattacaacatcgcatgtctgcatcctgattgtgctgctgctgatgttggggctggcgatcgcggcaaatcggacgatgaaacatgcaaaggaaattccggagggctttcaaaatgttctggagatcatggtagagaaactggatgcgatggtatatggaacaatgggaaaagttgcggcgccgaaattcgtgaactacatcagcacgatttttgtgtttatacttatgagcaatatttccggtttgttcgggttgagaccgccgactgccgactacggcacaacgctggcgttaggtctcatcacatttgctctcatccatatcacgcagttcaagaatctgccgcctaagcagatctggaaagatatgtgttctccactgccgccgtggctgccgatctggttcccaatcaacctgatcagcgagatcgcagtaccgatctctctttccttacgtatgtttgcgaacgtactgtcaggaacggtcatgatggcgcttgtatacggactgcttggcaagatagcgattatctggccggcggcgcttcatgtatactttgatttgttctcgggagcaattcagacatacgtattctgtatgttgacgatgacttacatcagtcagaactatgagacggaatagacgtcgaaaccaaaaagattattttaggagggtatcagtatgaatatcacaggagaagatttaattttagcatgctcagcaatcggtgcaggtctggcggttatcgccggtatcggacctggtattggacagggtatcgcagcaggacatgcagctgcagcagtaggaagaaacccgggtgcaaagggtgacatcatgtctaccatgttacttggccaggcggttgcagagacgacaggtctctatggtcttttgatcgcaatgctcctgcttttcgtaaaaccgttggtataggaagagacggagagaacgaatataacggaaaggaggccggaccttggaagagatgaccagactctttaatctggatttccagctgctccacgatgtcgtgctcatggcgattgcggtatttttcctgttcatgatgatgtcgaagctgctgtttaatcctgtcagaaagatgcttgccgacagacgggaaaagattgccggagagttgtcggatgccgcgaatgacaaaaaagacgcagcggcgttgaaggcggattatgaagccagattgaagaacatcgacaaagaagctgaacagattttaagtgaggccagacagaaggcgcagaagaatgcagcgcgtatcgagtccgaagcgaaggaagaggctgcccgcattatccagagagcgaacgaggaagcagagctttccaagaagcgtgcgatggatgatgtcaaacaggagatgatcacggttgcatccatgatggctgcaaaagtggttgcggcaaatatcgatgcgtcggtacaggatgcgcttgtggaagagacattaaaggaaatgggtgattcgacatggcaaagctagtatcaaaggtatacggtgatgcactgttcgaggtcgcagtggagagcggcaggctggatgagatctgggagcagaccagagccatgcagaccgcgctggaggaaaatccggagcttttcgcgctgatgcgtcacccgaagatcgtaaaagaagaaaaagtaaagatcatcgaatcgatttttaccgacgaggtgtgtgcagaactggtgggacttttgcgcatgattgtggaaaaggatcattttgcacagatcgggaaggttttggcgtattttgatgatcaggtcaaagaatataagagtatcgggactgcatatgtgacgactgcaatggaattatcggatgcgcagaaggcagcagtggtgaaacgcttattagagaccacaaagtatgtaacatttgaaatgcattatgaagtggattccgcgatcataggcggaatgatgattcgcattggcgatcgtgtcgttgactcaacggtcaggacaaagttgtacgatctgacgcgcgaattatccaaaatacagttgaaagcaggtgaatgcgctccatgaatttaaaaccagaagaaataagttccgtcatcaaagaacagatcaaacggtatgcagcgcagttggaagtagctgacgttggcaccgtaattcaggtggctgatggaatcgcacgtattcacggtcttgacaatgcaatgcagggagaacttttggagttcccgggcgaagtatacggaatggtattgaacctcgaggaggacaatgtgggtgccgtacttctcggttcccagaagaacatcaacgagggagatacggtaaagacaacggggcgtgtggttgaggtcccggttggcgatgccatgttaggccgtgtcgtaaatgcattgggacagccgattgacggcaaaggaccgattcagacatcgaaatatcgtcagatcgaacgtgtggcatcgggagttatctccagaaaatccgtagacacaccgttacagaccggtatcaaggcaatcgattccatggttccgatcggaagaggacagcgagagctgatcatcggagaccgtcagaccggaaagacagcaatcgcgctcgataccatcatcaatcagaagggacagaacgtaaagtgtatctatgttgccattggacagaaggcatcaacagttgcatcgatcgttaagaccctcgaagaattcggcgctatgtcttacacgaccatcgttgcatcgacggcgagtgagcttgcaccgttacagtatattgcaccgtacgccggatgtgcgatcggtgaggaatggatggagaacggacaggatgttctcgttgtgtacgatgatttaagtaagcacgcagcggcataccgtacactctccttgctcctcaagagaccaccaggacgtgaggcatatccgggagatgtcttctacttacactcaagacttcttgagcgtgcagcaagactttccgataagctgggcggcggttccctgaccgcgcttccgattatcgagacgcaggcgggcgatgtatctgcctatatcccgaccaacgtgatctccatcacggacggtcagatctatcttgagacagagatgtttaacgcaggtttccggccggctatcaacgcaggtctttccgtttcacgagtaggcggttctgcgcagatcaaggcaatgaagaagatcgcggcgccgatccgtaccgagctggcacagtacagagagcttgcagctttcgcacagttcggttccgagctggatgcggatacgacggagaagctgacgcagggcgagcgcatcaaggagatcttaaagcagccgcagtatcagccgatgccggttgagaagcaggttatgattatctacgcggcaaccaacaaatatctgatggatattccggttgcggacatccttccgtttgagaaggcactgttcgagtatgtggatacgaaatatccggaggttccggaagcaatccgcactgagaaggtaatcagcgaagagacagaagcgaagctcataaaggcaatcacagagtgcaaggcagagttcacaaagtagacggcagaaaggcggtgtgcgtattatggcctcgatgagagacataaagagacgtaagagcagtatacagagtacacagcagatcacaaaagccatgaagctggtgtctaccgtgaagctgcagaaagccaagaaccgtgcagagcagacgaacccgtatttccagtatatgtaccggacagtgacttccatgctggcgaagtccggcacgatcaatcacccgtatctcaagaagggtgagagtgacaaaaaagcggttgtggtcattacttccaaccgtggacttgccggaggttacaactccaacattgtaaagctggtgaccggaagcgaggacatcacgacagagaatgcgaaagtctacgccatcggtaataagggaagagaagctctggagcgaaagggctatgagattgcagcagatggatcttcgattatggagtccccgtcctatgaggatgcggcggagctctgtaaacagattttaaaagcctatacggacggagagatcggagagatctatcttgcgtatacgcattttaagaatacggtgagccatgagccgaagctcatcaagcttcttccggtggagttcgacgaggacgagatgcggggagcggcggatgagaaggtgctcatgaattacgagccgaacgaggaagaagcgctggatatgatcattccgaagtatgtcaccagcctgttttacggggcgctggtggaggcggttgcgagtgagaacggagccagaatgcaggcgatggattctgcgaccagcaatgcggaagatatgatcagtgatctgacactcaaattcaatagagcacgtcagggctctattacgcaggaactcacggagattattgcgggagcttctgcgatatcctaggaggcagcagtgcaaaaagttccggcgccggatggcggtggaagcgcgaagctgcatagcaggatttggtgatagaaaataacagacaaggagaaatagcgatggcaaataatagaggcagtcaggattgcccgggtaagattacccagattattggtgccgttctggatatcaagtttccggaaggcgcgctgccggagatcaacgatgcaatccgcgttccgttaaagaacggtggtgagcttgtcgttgaggcttcccagcatctgggtgatgatacggtcagatgtatcgccatgggaccgacggacggacttgtgcgcggtatggaggcaatcgccacgggcggaccgatcagcgtgccggtcggagagaatacgctcggacgcatgttcaacgttctgggtaatccgatcgatgagatcgacgcgccgaaggatgtcgagcactggccgatccacagaccggcaccggcattcgaggatcaggcaacgtcgcaggaaatgcttgagaccggtatcaaggtcgtagatcttctctgcccgtatcagaagggtggtaagatcggacttttcggcggtgcaggagtaggcaagacggtattgatccaggagctgatccacaacatagcgacagagcatggcggatattccgtattcaccggtgtaggtgagcgtacccgtgagggtaacgatctctactacgagatgaaggaatccggcgttatcgataagacgaccatggtgttcggacagatgaacgagccgccgggagcgcgtatgcgggtggcgcttacgggacttaccatggcagagtatttccgtgacaaaggtggaaaggatgtcctccttttcatcgacaacattttccgttttacacaggcaggttccgaggtgtccgcactcttaggacgtatgccttctgccgttggctatcagccgacgttacagacggagatgggtgcgctccaggagcgtattacatccacgaagaacggttccatcacatccgtacaggcagtctatgtaccggcggatgatcttacggatccggcaccggcgacgacattcgcacatctggatgcaacgacggttctggatcgttcgatcgtagagcttggtatttaccctgcagtggatccgcttggatctacgtcgcgtattctggatccgcgtatcgtgggtcaggagcattttgaggtggcgcgcggtgtgcaggagattttacagaagtacaaggaattgcaggacattatcgcaatcttgggtatggatgagttgtctgaggacgataagcttgtcgtaaaccgtgccagaaagattcagagatttttatcccagccgttctctgttgcaacacagttcaccggtctggaaggaaaatacgttccgatcacggagacggttcgcggattcaaggagattctggaaggaaagcatgatgacattccggagagttacttcttaaatgcaggaaccattgatgaagtgcgcgaaaagtataacaacgcacagtagcggaaatgaggataagctatggcagacgagaacaaagtatttgacgtggagatcattacgccggatcgtgtctttttcacgggaacggcgacgatgatcgaatttaatacggctgccggagagcttggagtgtatgcgcggcatattcctctcacaacggttcttgcgccgggggttgtaacgatccacaagcagggcgaggaggatatcattgctgcggttcattccgggtttgcagagatcctgccggaaaaggtaacacttcttgcagagattgctgagtggccgaacgagatcgacaaggcgagagcggaggcggcaaaagcacgcgctgaggagcgtcttgccaatcggacagaggcgattgatgtcaagcgtgccgagtttgcgctgcgcaaggcgctggtgcgtatcgatattgccagataataaaaacggaaagtcagggaaaccggactttccgttttttgtgtgtatttgctcttggaaaagatatcggtcctggtatatacttagggtggaaacggtaaaaaccatgcaggcaccatgaatggagaggcatatgaatttttactttacacgccatggcgagacggaatggaatgtaaaaaagaagatacagggaacgacggacattccgctggatgagaagggaatacagcaggcgaagcggctcgcagagacactcttagagaagcagcgaaacggggagcttcatctggacagagtctacacgtcgccgcagcttcgggcggcagagacagcccgtttttccgcggaggcgctgggcatcgactgcatccggctctgggatctgcgagagatggatctgggagactgggaaggcaggaactgggatgagataagggagacggaagcagagcggcatcacatctgggatacccacaggaggttctgccatacgccgggaggagagtgctataacgaggtgttgcggcgtacgctggctgcgctggaacagactctggcgcacgagaaggacgacgtgcttgtcgtgacgcacagtgcggtgctgatggcgctgcggtgttatctggcgaaccgtccgtttgatgtgatgcgcgaataccggacgcgcaacacggaacttgtgcgggtgacggaggaggagatccgggaggcgatccgccgctatgagagagcaatatgagatactaattttgtgaggaaggatgatttcgtgaagaagtcagccttctttttatttgtgtgttttatacaaatttcgatgacgatttttgtgaacgattttgacggaaaatgattgactgtgactggaaacggaaatataatgcaactatagagatgaacgattttgaacgaatatgacggaaaacggagaataaattatgctgacagaggaaagatttgcaaagattttgtccatactggaacgtatggggagtgtgacggttcagcagctgatgacggaacttgacgcttctgaatccactgtgcgaagagacctgaatacgctggatgcaaacggccagcttgtcaaggtacacggcggagcgattttaaagaatacggtctacagtaccatcgatgatgaagtggttcaccgcaaggagcagaaccgggaggcaaaggataagatcgcacgctatgcggcgggactgattactgccgaagattttgtttatatcgatgcaggtacgacaacggaacggatgattgattacattgcaaaccgtcaggcggtgtttgtgacgaacgccatcggccatgcgaaaaagctggcggagcatggatgcaaggtctatatcctgggcggtgagttcaaggcggtgacagaggctatcgtcggtgaggaagccgtttttacactggataaatacaattttacgaaaggcttctggggagccaatggtgtcagcctgcagaggggattttccacaccggagttaaaagaggcgatggtaaaacggaaatccatggagaattgcagagactgttacattctggcggatgagagcaagttttcccagatatcgagcgtgacgttcgcaccgtttgagaaagcgactgtgattacgacagagttaaaacaggaaatatacaaggattgttccaatatcattaaagtcgagtgagaggagatcttgggtaatgatttatacgttaacatttaatccatctttagattacattgtgactgttccgaagtttacctgcggggtggttaaccgcaccacggaagagattattttccccggtggaaaaggaatcaacgtatccatggtgttgaagaaccttggctttgagaatacagcacttggcttttatgcgggatttaccggcatggagctgaagcggctggtggctgataagggaattcatgctgaatttatcccggtagataagggaatgacgcggatcaatgtcaagctccggtcagagcaggagagcgagattaacggacaggggccggcgatcgctgcttctgatattgataaattatatgaaaagctggatgcactgaaggatggcgacatacttgtcatggcgggaagtattccggatgtgatgccgcagacgatgtacatggatatcatgaagcatctgcagggcaggaatttaaaaattgtggtggatgccacgagagatcttctggtaaatgtacttccgttccacccgtttttaattaaaccgaacaatcacgaactgggagagatttttggcgtggagatctgcgagaaagaggatgttgtgacttacgcgaagaaactgcaggagaggggggccagaaacgtgcttatttcgatggcaggagacggagcggtacttgttgccgaggacggatcggtgtatcaggcagaggcaccggagggaaagctgatcaattctgtcggagccggcgattccatggtggcaggctttcttgcaggatatttggagcatggaacctatgacaaggcatttcagatgggggtatgtacaggaagtgcatccgctttttctgaagagcttgcaacaaaggcagaggtacttgatctgctggagaagaaccaaaacttgttttaattttgcggcaaatgagaattataaaatgtgcgcagattaaatagaaaccatttaacattatggaggaggaagaatcatgagaatcagggaattgttagcagtagagagcattgacctgaatgcaaaagctgcaagcaaaaaagaagccctcgatcacgcagtggatctgatggcgagaagtggtaagattggcgacgtcgagacttatcgaaaaggggtatacgcaagagaggaagagggcacaaccggtattggtgaagggattgcgattcctcactgcaaatcagatgttgtaaaggcaccgggacttgcggcaatgcgtgttgcaggcggtgtggatttccagtcgctggacggtgagaaggcagacctgatctttttgatcgctgcgccgaacaccaaagacaatgtgcatctggacgtattaagcaaactttctgtactgctgatggatgagaagttcacaaatgatcttcggaatgcaaagagcgtggaagagtttttacatgtcattgatgtggctgagagtgcaaaggatgtggaagaagccaaagaggcaccggcaaagacagagacaaagggcggcaggctgatccttgcagtaacaggatgcccgaccggtatcgcgcatacgtatatggcagcagagagccttgagaagaaagcagcagagttaggataccgcatcaaggttgagaccagaggttccggcggcgccaagaatgtgctgaccagagcggagattgccgaggcggattgcattatcgtggctgccgatacacaggttccgatggagcgttttgatggcaaacctgtcattgagtgcaaggttgcagacggtatcagcaaggctgaggaactgattaagagagcaatcaatggagatgcggctacataccacgcatccaataaagaagcggcaaatagaaacgataatgagaaggacagcgtcggacatcagatttataagcatctgatgaacggtgtatcccatatgctcccattcgttgtcggcggtggtatcctgatcgcactggcattcctgatcgatggattttccgtagatctgaattctcttccgatggatcagagaagtaacttcggtacgattacaccagtggcagcaatgtttaagtcaataggtggcgcggcattcggatttatgcttccgattcttgccgggtttatcgcaatgagtattgcagaccgacctggtcttgctgttggttttgtcggcggagcgatcgcggcaaacggaacttccggtttcctcggagctctggtagccggtttcctggcaggctatgtagtgcttctgctcaagaagatctgctcaaagatgccggaaagcctggaaggcatgaagccgatgctgatctatccggtgcttggtatttttattacaggtgtgattatgacttacgtggttgagccgccaatcggagcattaaacactctgatcaacaacggactcaatggattaaacggcgcaagtgcaattctgctgggtgcactgctcggcggtatgatgtctgtggatatgggcggtccagtcaacaaggcagcttatgtattcggtacagcatccatcgcagccggaaactataacatcatggcagcagttatggtcggcggtatggttccgccaatcgcaatcgctattgcaacattagtattcaagaacaagttcaccgcagaggagagaaaggcaggaccgacaaactttataatgggactttcctttatcacagagggtgctatcccgtttgcagcttctgacccgttacatgtacttccatcctgtgtggtaggatcggcagtcgcaggagcactttccatggcatttaactgtactctgatggcaccgcacggcggaatcttcgtattcccgaccgtcggtaatccattcatgtatctggtggcactggcgatcggatctgtggtatctgcggtactgttaggcgttctgaagaagaacgtggcataaataaggtttcttcttaatattatttgatgatatacccatatacaaaaatccccggggcggcatgcaatagcgtgccgccccggtggtttttgtatatataaatatagacaggaaagagcggttgtgctaaattaaaagaaaaccacgcaatgaggacttggcagaaggggatgctggtatggaaacaagtgagacagtaaaagaaatacgcagccggacagggttaaacagaaaagagttttgtcaaaaatttggtattccgctcaggacgatggaggagtgggagacaggtagaaggatcccgccagaatatattccaaggatgctggcatactatacgagaagtatagatacagacaatgcgaggaatgagataagaaatcactatgacattgtggaagatgcggaaggaaataaagttgtcattatcaatgatttacgatttaaaagcagaaggaatattgactggaatacagtggaacagtgtttaaaggaatatgttggaagctgcgtgcagattttagaaacatccgatgagatttatatcgggaaagattttccggatgaatatacgcattccaaagatacgaaaagcctaaaaggtgcaaatcggcatgcaaatgcatctcagattgtagaaccaatgataaaaattgccgccggtaaaacatttgcgcctaattacgaggaaaaacatgtggcagatgcaaaatatggatggtatcgttatgatacacgttttgcaatacctgtatacaacgatgagggaaatttgtgcagatataatatctttggcgcaaggattttaatacgccatgatgaagatggaaaaatgtatttatacgatattctgagaataaaaaaagaaacgagcgagccgcttgagcaatagctgtacggtcgaaaaactcatttcttagttgtattataacaggataactataaaatgcaagaaaaaattaaggacagagcagggaaagaataacacaggaggattgcgatgagtcagtatttattgttaaaacagggaacgatccataatgccgtcgacgaggaggcatttgtggcggatattttgattgaggacggaaaaataaaaaagattgcgcctgtgctggagggcaaagtcatcaatgaagcggctgtcattgatgcgatggggatcgatgtctatcccgggtttgtggatgcacactgccatctggggctcgacggttatgcggtcggttttgcggggcaggacttcaatgagcttggcgatccgatgacaccgcagctctcggcgatagatgcgatcaacccgcaggatgagactttccgcatggcaagggagggaggcgttacctgcgtgtcgacaggaccgggaagctccaatgtgatcggaggaaccttctgcatcatcaaaacgtatggaaaccgcgtggacgacatgattgtccgggaaaaatcagccatgaaaattgcattcggagagaatccgaagaactgttataaggaaaaaggcgtctattcgcgcatgtctgtggcggcaaaactgcgggaagtgctgcagaagacgatcatctacgataaaaagctgcgggaggcaggctgtgagacaagctggaatgagatcaaccgcggcagcggggaggggcaggtggacatcagcaaaatgccagcctacgatgcaaaactggaagcaatgctgccggtcatccgcggggagataccgctgaaagcgcatgcacaccgggcggacgatatctgcacggcaatccgcattgcaaaggagttccatctggggttaaggctcgatcacgtgacggacggcgcgctgatcgcaaaggaattgggtgcggagcattttccggtggcggtcggtccgtccttcggtcatgcgacgaagtacgagttgaagaacaagggatttgagacgcctgcaattctggcggatgccggctgcgaggtgtcgatcatcaccgattcgccggtcatcgaggagcgctatctgccgctctgcgcagggcgggcaatctacaacggcatgcgtgagtttgatgcgctgcgggcaattaccattcaggcggcaaggcatatcggcgccgaagatcgtgtcggaagcattgaagaagggaaggatgcagattttgttttgctaaaaggcaccccgttttcggttgacgcgcggatattatataccatcataaacggagagattgtctatcagtccggggagtaatgtgacggttatctgaatgttatgtgaagtctgttattttttctgcggcagaaccgatagctattttgaggaaaatgcaaaggatggcacaatttcgggaaggaaccacctcagaaaggaattggttatgaaggtcgagagttcaagttacgaggcatatctggaagcactggaagagtggaagcagaagatgcaggagagccaggccgcacagcagaaggaagagaacagcgctacggacagttatgtgccgggcatcagccagatggacatggacattccgatgccgagcagcacttacaatgcacaggggatgatgagcggagaacgcccgccaatgccgccgatgccgccgcaggagacggaggagacagacgagacgacggagagcacacaggtcacgggaacgacagagacgcagggaaccgcagcgacaggaacagaggcattgcttgaggagttgtcagagacattccgcgcaaatccggacagcatcctgatgaagctggatgaattgggattatcgctggaggatctgggtgacgaggataatcttgcattacttgccaccgcaatgaacgaaggagcggcaaatatgggcttgccaaccattgaagatctggattctgtggtaagcaccctgcatgagaagttgtccgcgaactggagcagctactttgaagtggaggaagcatagatctcttttggggataagtaatattataagaaacacaccgtgtggatttcagatggaaatgcagatggaatattcgttggagaaaaatgtgagcatttcttccgatcgaatggttgcatcagattccgtgtcttttccacgtttggacaatccgacgggtgcatgtccgacacaccggagacaatgggcggactttctggtgtccctaatggcacctcttcacagacaatataaaaccgcgcgaaccgaactcgccggcatctgctattgaaaatagggcagatgccgactcagatagcggcttcgcgcggttatgttttgttcagaggtgccataagggacacacacaaaagtcctacaaattgtcttccggagtgcggacatgacccgtggagtgctccaaacttggaaagacacggatcatcgaagatgcaaccattcggttggttagaaatgccatattttttgaaccgaatattccatctgtatttccacatgaaatccccaagtgtgtttcttataatattacttatcaaggcaaagcatggaagggaactttttgtttgcataaatgtggcgcgtggattatagtattcgtataaatatagaagaaatgaagcgggaggcagtgcggcatggagtcgacattgagacgtacctgggcggagattgatctggatgccctggcacacaattatcataaattaagagagagaatcggtgcagatgtaaagtttctgggggttgtgaaggcggatgcctacggacacggttctgtacaggtatcgcatctgctgcaggagcttggtgcggattatctggcggtcagcagtattgatgaggcggtcgagttgcgtttaaatgacgttacgatgccgattttaattctcggacacacaccgaaggagcaggtatcaagactgatcaaatatcacattacacaggcggtcagctgtgaggcgaaagcgcttgagtacagcgaagaggcggtcaagtgcggcggcatcttaaagatccacatcaaggtggataccggaatgtcgcgtctgggatatctgtgcgacggagatcattttgagacgggcgtggcgggaatctgtcacggctgctcgctgccaggactggatgcggagggtatctttacgcatttcgcggtatcggacgagcctggcgaggactgcaaaaaatacacggagcatcagttcgacctgtttatgcgcgtgattgaggaagtcgaaaagcgcctgggaagaaagttcgcgctccgtcactgcgcgaacaccggcgcggttgcaagatatccggagacctttcttgatatggtgcgcccgggactgcttctgtacggctacggggagtttgcggacgagctggggcttttgccggtcatgacattaaagacgacggtcagcaccatcaagatctatccggcagggacggcgatcagctacggcggcatttttaagacagagcataccacgcggatcggcgtggttccctacggctatgccgatggctttttccgctgtctttccaaccgctgcgcgctgatgacaaaagagggaccggctccgcagcgcgggaagatctgcatggacatgtgtatgatcgatctgacaggaaaaatgggtgtggatgttggaagcgaggtcgaggtgttcggaaaacagaactccatcaatgatcttgcggcacttgccgggacgattccttacgagcttacctgcgcggtgagcaaacgtgtgccgcgtatctatatcagaaatggcaaagttgtggaaaaggaacttctgttaagaggatagaggaggcggacggaccggagatgtcagaaaatggcatttccggtttttttataagcgaaaagatgccgatttataagccttatgtataggttatgtaaaatctagtaaaaatttagtaaaagtttactaacgctattgaaattaaaaaaaacgtgaaatataatgcagaagaaaggcgtgattatatggcaacaatcaaagaaattgcagagttagcaaaggtatcaccggcgactgtatcgagggtactgaatcaggatgagacattgaacgtcacagcagaagtcaggagccagattttaaagattgcccacgaattaaactatattccgcctaagatgcgtcatgcgcagaataagacccatgttacgatcggtgtggcagactggcatctggtaagaggggacaggcacgacatacgactggcatcgctggaccatatcgcagcgacgatgccgcagaaggtggacgtcagctttttgcggatcacctgcagggaagatgcagatgtcgacgggattctcgcatttggatctttttcggaggaagagataaattttctgcgaaaacagagtgatgcgatcctgtttgtcaattcggatcagaaagattatgagtttgaccagattatcatggactatgagcagggcttaaaggatatggtacactatcttctggatgtcaaggaataccggagtatcggttatatcggcggtatctatgagaaggatggtgtacggatcggtacccaccgcttaatgggactgacggagatccttgcgcagagagggtgctataaggagcactatttctgtgtgggtgaaatcagcagagagagcggctaccgtctgaccagagaacttctggagacagatgatgtaccggaagttctggtgcttggaaatgatgaggtggcagaaggcgccctggaagcggtaaaagaattaaaataccggattccgaaggatgttgcggttgtcatttaccgtgatattgagacgctgcagacgaaatatccgacatataccagtcttcggatgctgccggatattgtatggtcaacagcaatcaagcttttgctggaacgaatcatcgacaagcgcgtggacagtatgaaggtttacctgccgacaaaattggaactgggcgacagtgcatgaataattgtttcactgcagagaggagaaatttgcaattatgaagagattgacagctactttactggcagcagcaatgtgcatgggtacatttgcaggctgtggaagtaacacagaagagacaacagataacagcaatgcaggtgcagcagcaggcgagacagcagctgctactacggagagccagacagcttccgctgagaatgtgcatctggatgcgttaaacgtatattttgtaccgtccagagatccggaagagatcgtaactgcaacagagccgttgagtgatctgttaaagaacgagcttgcgggactgggctatgatgtagacagtgtaaacatttccgtaggtacgacatacgaggcagtaggcgaggcactttccgccggaacagcggatgttggatttattccgggcggtacttacgtgctctatgatgacggatgtgatgtgatcctgaccgcaaccagagatggtctgaacaaggactccgacaatccggcggactggaatgacggacagccgacagaggcatctgacaagcaggcagtatcttaccgtgctctgttcatcgcaggtccttctgagaaaggacaggagcttgcagacaaggtaaattccggagaggagcttacctgggatgatctggatagcgcaaactggagcgtgatgtcttcttcttcaccggcaggctacatttacccggcattatggatgcaggatcgttacggcaagggcatcacagatctttccaatgcagtacagtctgattcctatgcaagtgcattcgcaagacttgcatccggacaggtagatgtattggtaacctacgcagacgcaagacgtgactacgaggaaaactggaccagcgagtatggacgctctgcttccatctgggaggagacgaacgtcatcggtgtgacagatccgatctacaacgataccgtctgtgtgagcaagacctctccgtacatggatgagaacttaaagacagccattcagacagcactgatcaacatcggcaataccgaagagggcaaggcggttatcgcaatctacagccacaacggatatgagccggcacagtcttctgactatgataaggaaagagaagcacagaagctgattcaggaactgaacgcagccaactaatcagaaacgggcagacaaagggtgcagtgtcagcggagtgatcttggaaagagacatcactccgctgtgctgcacattttttaaggcaatgtggaaggagcatttatgatagagttttcaaacgtatccaaggtatatcccaacggcgtggttggactcgacgatgtcaatcttacgattgagcagggcgagtttgtgggaatcatcggtctttcgggagcaggaaaatcgacactgcttcgcacgatcaaccgtatgcatgacattacttccggtacgcttacagtggacggacaggaggttaagaacctcaaaggaaaacaactgcggaaattccgccgcaatatcggaatgatttttcaatcctttaatcttgtgacacgcaccacggtcatccgcaacgtattgatggcaaaagtgcctgagatgccgttctggcgtgtattactcggtatatttaaaaaagaagacaagttgaacgctttggaggcactcgacaaagtgggcattttagataaggcatatatccgtgcggaccagctttcaggcggacagcagcagcgcgtggcgctcgcccgcacacttgcacagaatccgaaaatcatcctcgcggatgagccggtagcggcgctcgatccggtaacagcaaagcaggtaatgagcgattttaagaagatcaatcaggaaatgaacattaccattttgatcaatatccaccacgtagaactggcgcttgcctatgcggaccggatcatcggtatccgcgccggaaagatcgtctatgacggaccttccgcggatgtgacagaggatgtgttaaacatgatctatgccggaaagataccggatgaggtggaggaagcctgatgggaatatatgataaaattttcaagccgaagaaactggtgttatccgacggaaaagtagtggaggaaaaacgcacgcgcacaccgcttgtacttcttctgcttctgattgcgaccgtcatttccgtccggattaccggtttttcgctcaatacgattctcacacgcggaaatcagttttttgtcatattaggacagatgtttccgccaaagacgggatatttaagcagtatctggggaccgcttttagatacgatcaagatgtcgctgctcggctccttcatcggtggggttctggcaattccatttgccatcctggcatccagcaatctggtcaaaaataaggtcgttctgggcgtggtgcgtatcttcttaagtatcgtgcgtacgattccgaccctggtggcagcactgattgcgacttatatctggggacttggaacaatggcaggaactgtggcaattgccgtctttacatttgcttatgtcggcaagcagctttacgagctgattgagacggttgacatgggagcttacgaagcgatggaagcgatgggagctggcagggcacaggcatttctggcagcgatccagccgcaggtgcttccggcatatctttccgtctgcctgttctgttttgagggaaatgtccgctatgcggcaatcctgggatatgtaggtgccggaggactcggtctgatcttaaacgagaagatcggttggagagagtacgacagcgtgggcatgatcctcgtggtattattcggaacggtgctcgtgatcgaggcactcagccattatattcgtaagaagcttacctaggaggggacaaggcagaatgaaaaaagaaatagataaaatgtatgagcagaagccgaagacgtggtatgcgaagattcttgtggcactcatcgttgcagcacttctggcatggtcgatgtccacggtgcaaagcggaacaacaggcggcgatgggcttacggtagcgggaaagattatcagcggcatttttcatccggacacagcgctcttatttaattttacaacctccggcgtggcgtatctgctgttggagacaatgtgtatcgcatttctgggtacgattgtgggagcagtgctctcgatcccgctgtcttttctggctgcagccaaccttgttccgaagccgattgcactgattttccgtgtgtttattatggcgatccgcacaataccggcatttgtatatggactgatgttcatccgtgtgacgggaccgggaccatttgcgggacttctgacgatgtccctgtgctcgatcggtatgatcagcaagatgtttattgagagtatcgaagaccttgacaccaagatactggaatcgcttgatgcagcgggatgcacgatgttccagaagatccgttatggcattctgtcacagttattcccggactttatgtcaacgttaatctatcgttttgacatgaatcttcgtgatgcgactgtgcttggtctggtaggtgccggcggtattggtgcgccgcttatttttgcaatgagcgcgtacaaatggaatcaggtgggtgcaatccttgcaggactgatcgtgctgattctgattgtggaagtaatctccacaaagatccgtgtgaagctgacgcggggataactataatacgactgagggataagatggaacaaacgttaaagatatattttacctcggatgttcacgggtatttttacccaacgacttacggggatttgaaacgaaaagatctggggctgttctcgtttgcccgggatttcaaaaaagatgagaatacactggtaattgatggcggagatatattgcagggctccgcctttgcctactattgcaggcagaagtcaggatcgccgcaggccattgtggatatcatgaacgactgcggctacgattattatacgctcggcaaccatgattttaattatgggatggactatcagaacgcttacatagaggctcatcacggcgcgtgtgtctgccagaatgttgtagatgaggcgggaagagcatgccatccgtatgtgatccacacgcttggaaacggactccgggtcgggattgtcggtattgtgacagactatgtgaatgtgtgggagcggaaggaaaatctcgcgggaatttgcattacagacccatttgaggcggcaaaagaggcgcttttgcatctgaaaaaagaggtggacattacgctttgcatctaccacggcggatttgagtgtgatttaaagaccggagagcgcctgcagaagacgacggagaatgtcggataccgcatctgtaaggaactggattttgacattctgctgaccgggcaccagcatatgtccgtcgacgggcagtatgtgcacggaacttatgtggtacagccgcttgagaatgccaaagagtatcactatctggaagcggagcggacaaaagacggacttgttgtccgctccgagaagcgtgtcgccgacggagcaaatgctgtcggtgcattatgcgaaaagtatgccgcagaggaagagcgggtacagagctggctggatcagccgatcgggcatttaagccgggcgcttcttcccggagaaaaagcggaaatggcgctgcacggttcgccgattgccgattttttaaaccggatacagttacatttttccggcgcacagctgtcagcggtcggtcttgccaatgagatcgccggatttcgcagcgaggtgagtgtccgcgacattatagcaacctatccgtatccgaatacgctcatcgtatgcaggatcagtggaaaacagttaaagcaggtgatggagcggagcgcggagtattttgccgtcgccacggatggaacggtgcaggttgcggaaagcttccttgtgccgaaggtggagcactataactatgactactatatgggggcagcatatgagattgacccggctgcaccggtcggaaacaggattaaaaatctgacttaccagggaaagacggtaacggagacagattcttttacgctgtgccttaacaattaccgttacagcggagcgggcggatatgaagtatatacggaatgtgaacttgtccgtgaaatcaatacggagatggtggaactcattctggaatatttcaaagagaatccttatgtggaagtgtaattgtaggtattgcacaaaaataaaaagataaattgaacacaagtgccgaaagtgtcgaaaaggatggaattgttgcaataagcatagccctcttttgggtgataagtaatactatgagaaatagatacttaaaagttccagataaacatgcggcggcaaattctgaccgcaaaatccggtatttctaaccatgccgcagccggcatccgtgatgatccgtgtctttccaagtttgaaacactctacggactgtgtccgcaagccagcagacaattttaggacttttgtgtgtgtcccttatggcacctctgaacaaaacataaccgcgcgaagccgctgtctgagtcggcatctgccctattttcaatagcagatgccggcgagttcggttcgcgcggttttatattgtctgtgaagagatgccattagggacaccagaaagtccgctcattgtctgcggcttgtcggacacactccgtgagtgtccaaacgtggccaagacacggaatgggatgccagccacggcatggaagaaatactcgaattttgcttcaaagaatttgccgccgtctgtttattctggaacttttttgttctctggtcttctaataatattacttatcactccaaagcacgatatgctcattgcggcagttccatcctttaatcgtttttaataaaaagactcttgtagaataaccgcattctgtgttaaaatatgttcaacaaaagcatatttcttacgagttcagggtgttcgcaccgtctattttcttatcacatttcagaggtctatgctttttatccaatcaacgaacgagaaaagcagggacgctggggtggcggttcctgcaaaaagggggaactgcatatggaagagaagaggccgaaggcgaggcgggagtacaaggatacggtattccgcatgctcttttcagacgagaagaatctgctgtcgctttacaatgccgtgaccggaaggtcatatgaggatgccaaggagcttgagattgtcacgttggacaatgcagtctacatggggatgaagaacgatctggcatttttactggatctgcacatctctctgtacgagcatcagtcgacgaagaacccgaacatgccactgcgggatctgttctatatttctttggaatatcagaagtatgtgagtgacaagtcgctgtattcgtccgcattgctgaagattcctgctcccgtgtttatcgtgttttacaatggcgcggaggacatggaggagcgcacggagcttcgactgtcacaggcatatgaacactttgagggagagccgaatctggaattgaaggttagggtgcttaacatcaatgccggacataatgcagagcttatggagcagtgcaggatgctgaaggaatatgcacagtatgtggcaagagtccgcgggtacaccgcttctatgaagctggaagaggcggtgcggcgggcgattaaggagtgtattgcggaagggatcttagcggatttccttcggaagaatcgtgcggaggtggaaatggtgagtattctggaatacgataaggaatatgaagagaagaagcttcgcaaagcggagtacgaagcgggggagcaggaaggtctgaaccggggtctggcacaggggattgtggagaccggatgtgcctacggcgtatcgaagaaggagattcttgagcggctgcaggagaggctgaacatatcctgccagacggcacaggagtattttgcaaggtactccggcaagaagatctcttagtccgaggctgccagagacagggtgctgacagataggtgcacaagtacacaggtatgatgctgtatagacggacggagacagaccgctacagacatctgagcccggcatgctgacagacacatcacagcatgccgggcttctttttgcgttaccgcgttacattgcgtcagacctcatttcgtggtagaataaacctatcttaagagctgatcgggatctaaggggcccgatgagtataaatggggagtatatttcacaattaaggagggtttttgcatgaaaaacaaaagaagaattctggcggggctgcttgcggcagttctgaccgtgccgctgtttgccggcggcgcacagataactgcggctgcggaggcggccgggaagacactggatgtggtgttcacgcacgacacccactcccatctgaacagtttttccacggtgattgacggagaatccacagaggtgggcggatttgcaaggatcaagacagtgattgatgagcagaaagcggagaatccggacacgctcgttgtcgatggcggtgatttttccatgggtacgctggtgcagaccgtctatgaggatgaggcggcagagcttcggatgctgggcgcaatcggctgtgaagtgacgacgtttggtaaccatgagtttgattaccgttccagcggactggcacagatgctgaagagtgcagccgaaagcggcgacgcactgccggagcttgtggtgtgtaatgtagactgggatgcgatggaggctgcggggttaaacgacggacagcagcagattttaagcggatttgaggagtacggcgtgaaggattatgtcgtgctgcaaaagggagatgtcaatgttgctgtgacaggtgtgttcggtgtggacgcacttgcctgcgcgccgacctgtgaactgttattccgcgatccggtggaagcagtcaaggagacggtggcagagatcaaggcaaatgaggatgtggacatgatcgtctgcgtatcacacagcggtacgtgggaggatgagagcaaatccgaggatgagattcttgccaggagtgtgccggatcttgacctgattatcagcggtcatacccacacagagctcgcggagccgatcgtgcacggcgacacgtatattgtatccacgggagagtacggcaagaagatcggagaactttccatgacccagaagagcgatggcagatgggagatagcggattataaactggttccgattctttcgaccatcactgcagacggagcgacccaggagaagattgatggcttcatggaagcggtggatactggttatcttgcagatttcgggtacaccaaggatgaggtgcttgcaaccaataatgtgcagttttccacgttgcatgatcttgagtatgagcacacggaacacaatctgggagatttgatgtcggacgcctatgtgtatgccgtggagaactccgatgattttgacggtgtgccggtggatgttgccgtggttccgagcggtacggtgcgcgatacctacacggccggggacattacggtggagcaggtgtttaattctttttcccttggcatcggtccggacggcgtgccgggatacccgctgatcagtgtctatctgacagggaaggaacttcgcacagccgcggagattgacgcgtccgtctccgattacatgacgacagccagactttatatgagcggacttcattttacatacaatccgaaccgcatgattttaaacagggtgacggatatttatctgaccgatgagaacggaagccgcgtggggcttgaggacgataagctgtaccgcgttgtggcagatctctacagcggacagatgttaagcgcggtgacggatatgtcgcacggactgttgtcgcttgtgccaaagtatgcggacggaacgccgatcgaggattttgaggacgtcatcgtgatggaggggaaccgcgagttaaaagcgtgggattcgattgccagatatatgcagtcctttgaggatacggacggcgacggtattgccaatgtgccgtcttactacagccagatgcacgaccgcaaggtggtggatgagagccgctcgctcggcgatcttgtaaagagcccgaataaatatgcggctatgattgtcgccgtgattctgattgtgataattctggttgtattactgattgtgttagtggtaaaattgataaaacgcatacggagacggaaagcggatacaatacataaaagataattgaaatacaggagaccattatgagtgcgcaggataagacagagcaggtgttgcgggaaatgcatatcatgtatgccaacagcgagatgtatgataaagcgacaaaccgggttatcatagacaaaaagaaggcgttaaatctcctgcagcgtctgaatgtctgcatctacgaactcatggaggaacatgagcttacccagcagagccgcgatgcagcagaacggcagttccgcaggaaaacggacggtattgtcgaggatgcgaaccgcatggcggaggatgtgtatgccggatcggtcatgtatacggatgaggcacttcgccgcgtacaggatattatgcaggatgcgatggactctgtccgggagatctgcgataagatgaatgatgcgctcgcgcaggaaaagtcaaatgtgcgcagggatcagtcggagttaaagagccaccttgaggatttaagggatacgaacaaatacatgaatctgatcgagcagcgcaacaaggagattgcaaaggaacgcgcgaagcgcgggcaggagaaagaagaggcgacttccgtctatgcatccgtaaagccggagatcaagataaacgaagagtattttgagaagaatggaattccgttagagacagaggaaccggaggaagagccggagaagaacaccggtgagaccggggcggagataaaagtaaatctcgatgcggaatacttcaaatggaaagaagacgctgacggcggcaaagaggagaagaaaccggagcgccattctttctttggcaagcggtcgaagtaatagaattgaagagagagtggatatccaattggtggaagatccgctctctttttttactctaaccggtaggcgcgcggcgacatgccatagtgcttccggaacgcatccccgaaataattgccgtcagaaaaaccgcagatccaggcaatttcagtgatcgaagtgtccgtcgtgcacagaaggtgcgcggcgttctgaaggcggatgtgcgttaagtattccttaaatccgaatccggttgtctcccggaattttttggaaaaataagtgggattcatatgtgcgaccgccgcggcggctgccagtgagaccggttcctcgtaatgttcgtagatgtagcgcgcgctttcctggatggcggtgctggtctcgtccagaaattgcggagtctggtggacatcctggcagcgcgcgatctcaaccagaagctctgaaaaaagacttttggtcatgagcggtgcataaggatcgctgctttcggattcaaggcgcaggcgcgtcatcaggcgttctaactgcggacggctggaagacggaatggtgagtctgctgcgggaaaaaagcccgacgcaaagatccgggccgctggcggcagacacccggtgtaagtaatcttccgaaaaaaagatgttgatgcgctcggcaggacgcttggtttcatagagaacgcggtgcagcacagagggaggaatcataatcagatcccctggaaagagccggtaaatgctgtggctgataaaacagcggcactgaccggacagcaggtaataaaattcgtagtacgggtgataatgggattctcccatatcaaaatgcgaatcgcgctgtacctgcgtaattttaaaatcggcaatgcggtcgtgacagctggaggaagcgaaatcgttcatgggtataactcctgttcctggttccgtgaaggtttctgcggaatggtgattctggatttttgcctgcaatgacaaaaaatcagtagtataaagcaaaataacggaaaaaattcgtataaataaatatatttttgttataccatgggagaacagaaaagtaaagaaacgcagatacaaaaagaatggagaagaacatgcaggcagatctttcaaaaaaggacgaacaatttcgcgagttttccctgaacggacccatgtggcgggtggtattgtatgtgggatttccactggcgctctatgagagcctgaaccagctttttaagatactcgataccatgatggcgtcacatatcggcgcatccgcggtgtccgcggtcgcgtatttgtcccagatcaacatgatgatctcggcggtgggaaccgggcttgcggtgggcgccagcatcaaggtgagccaggcatatggggccggcgatttcatgctggtaaaaaagcgtgtcagcacaatgtttgccatgtgcggggcgctcggtatcgcaatactgcttgtcctggtgccgttcacgccggagttcctgcgcctgatgaatacaccggaagaatttattgcggacgggagcacgtatttcaggctggagttgttcggaatggtcatcacgtttttcaataacgtctacatcgccattgagcgtgccagaggaaattccaaacggattctgattctcaatacggcggtcatcgtagtgaaactggggctgacggcatggtttgtctacgggctggacggaggcatcaatatgatctcctgtgcgacgatcatctcacagagctttcttcttctcgctgcgtgcatcaatatgaaccagaagggaaatgcgtttggcttctcattgcgtgccatctccataaaaaaggaggtcatctgcccgatgctcacgctgtcgtttccggtcatcgtggagcggattgcgtttgcggttggaaaggtgattgtcaattcgatgagtaccgtctacggttcctggacggtgggagcgcttggaatctccaacaatatcggcggaatcacgacaaacccgcagaacggatttcaggagggaggctcctccattatcagtcagaatctgggggctggcagaccgaagcgcgcgcttttggcgttccgctgggtgctttacattgacatgctcatcggactggtcatcatgacggcgtcgctgttatgcttaaaccagctggcaggtctctttgccggggacaatgcagagtttgccgagatgatcaaacagatttaccggtttgaggcggtcggagcaatcccgctcggcgtcaacgcggcggtaatggcgctgctctatggatttggaaagacgcgtgtgacgctggtcatgaacttctgccgtgtctttctgttccgagtgccggtactttgggcgttgcagcagttcacggatctcggaaacgtcagcgccggcattgtcatggcggtgagcaatgtggcgagcggcgtgcttgcagcggtggtgggcgtcatcgagatacgcagaatctgtaacacatacgatgtgcggtattttggcggagaacggaaaaattaagaaataaaaactacacctatagattgcaaatatttcaactctatgttaaaatgtctaaaacagtatcaattcgatagaataaaggacaggacatgagtattaaagatagaattctgaaaaggcgggaaagatttgcatacgaacgcgcacactgggtggatgcggatcccgaagagagctggttttatcttatgacgaacatacagcgcaacaacctgtattcgctggtattgatcggaccggcaattttttgcatcttattttactattttacagggattacgcccaatattgcgctgtcttatctgatcattgacatgatcgtcatcttttccaagaggcattttgcaatccgaagaatccgggaggatcaggcgtatgcccggctcggtgaccgcacagaggttcttttgcagatggcgcgggaactaagtgaaaaagaccagatgaagagggaacagaatacagatcacacagataaaagggataagaataaaagacacaggagaagaggagggacagacaaaagagacaaaagaaagagtgacactacgaccgggtagcgtccgtgtgcttcatgacttcgacaagttcacgcagaatacggatctgcgcatcggtgaggtcttttacctcgatgatcgtagcgtaggaatcggtcgtggttcgtccgagaatatagtccgtggatgtgtgatagatatcagccagtgcgatcaggcgctccagactggggttacgctccgttttctcataagcgctgattaaggcaggcgttacaccgagacgatttgcgactgcactctgggacagatgattcttttcacgtaattcaattaaacggtctgccatattcttgtccataatcaacgcctcgctttcctgcttagtctagtgcatgtttcccatacttgcggttatgaagagatcaactgtaagttgaaaacgatactacttagaatatgcaggacatgaaaaaatacacccgctgaagataaagaatatcatagcaggtgtatttttatcattaaaggcgcagttgtcactgatatggcagaaagcccatttgaagcgggatcagaagccgtcgccctcgcggtaaccggttttgctggtgatcatttcactgttgtttttcactgtatcggaaggcgtgtaagccatatctgtatagaggaactgatgaagtgccgtgacattggacgataggtcgcagggaatcacgacatctcccactttgttatagcggtgggcggttttttcatatgggaacccgttggtctcgctgagcttgtaattaaaaatattggtggcgagtgcaagcagatccgcattggagaagctggtctgaatatcgctgaagagagtgttgattagtgcgttgagcgtcttcagatcggatttttgtgctttggcaatcatagctgaaagtaccgcacgctgacgttccgtgcgcttgtaatcatcaccgccgccgtaacggattcgtgcaaatgccgttgcctgcacgccgtttaaggtgtaagttccgccggaagacgggcaggaagcggtatttccggtaaggcggtttaattcctgaatatagccgagcatcaggctggcttcgtcatcggtgatcgtcatttccacgccgcccagcagatccacacattcgacaattgcactgaaatccaccgtcacataatctgtgattgcaagatcgagattggtattgagcattgagagcgcctgctcgggtcctccttttgcgtaggcggcgttgcatttttcaaagactccgctgccggtgtccagataggtatcccggtagatggagaccagttggacctcgtgcgttttgttgttgatattggcgagcataatgacatcgctccgccctttggacagggaattgtttgtacggttgtccagaccgaagagagcaactgtgcgatagtctgacatggcatccattgtttcggaggacagatcttcattgatggcgacttgatccatgtcaagctttgttttctgtatttttgaaagttttacaactgcaaacaacaaaagagtcagcagaagaatcagaataatttctgcaatcagcaaaatgactctgcggcgtttcttcgtttttttctttttcatatcaaagatcctccagaataaaagcatggttgggttacctgcttatcttaaagcgggaatatgccgcccgcaataaagattctcttaattttgcgcgcagatttttaaaaataattaagaaatctcctctataacaatttgcgcgtgtctgttaaaatgaagaaaacaggcaatagaaaggctgatatgcagtgcgatatctgccacgttagaatggagagaagagaatgcagacaattctggtatgtgatgatgacaaagagatcgtggaagcgatcgacatatacttacagcaggaaggctatcaggtattaaaggcgtacgatggagaggaagcgcttgagatcttaaaagaaaaagaagtccatcttctgatcatcgacgtcatgatgccgcggctggacggcatccgggcaacgttaaagatccgggaggagagcagtatcccgatcattattctatctgcgaaaacggaagatgcggacaagattttaggacttaatatcggcgcggacgattatgtggaaaagccgttcaatcctctggaactggtggcacgtgtaaagtcgcagcttcgccgttatacgcagcttggcaatgcggcagagaacgacgcgtccgtatataccgtcggcggtctgtcgatcaacgatgatttaaaagaggtcacggtggacggggagacggttaagctgacgccgattgaatacaacattctgcttctccttgtgaagaatcaggggaaggtattttctatcaaccagatctatgagagcatctggaacgaggatgcgatcggtgcggacaatacggtggcggttcatatccgccatatccgcgagaagatcgagatcaacccgaaagagccgcgctacctcaaggtagtctggggcgtgggctataagattgacaagaactagaggagcgtctttatggagaaaagatcctacagttacggaatgaaaataacgggagtgctccttcattccttttttacaatcgttcttacagtgtccgtgttccttctggcatcgcttgtcagcaagaatattctggagcttaccgatattggaaccgatgatttccttagttccgggtattatctgaaatgcatggagcagaagtgcaatgatctgaacgattatctgctcctaacacagaaaggcgcgcttcggacagcggaggatgagaaacgctatctgcagtataccaatgaatttaagcaggagagtacaaatttctgctactggtataagatcaatggcgtgtggtatactaatcagccagataccagagaggggcagcagttcgatacgcagacggttctcatggaggcaaagaccatgggagattatctgctttacgatatggaagacaaggaatttggcacggatatccggggactggagaattattttttcagcaataacggcaatcagatctactggcccctggaagacgtggtgcttgtcatcggcgtggacacacagctttcggcaggggatgatctgcgggatgccaagatagaatatgaaaggcttcatccgtggatcaaagtgagcattgcaggggcaattatcagtctgctgggctggattctgacgcttgtgtacctgacactggcagcgggacacaaggagggggaggaaggcatcgccttaagctccattgaccgcatcaagaccgaacttatgattgctggctttgtgtttttatcggcggagctggttatgctgcttgcgagagcaagcagccgggaatgggaggttgcaggtctccttgtcgcatcagggaccatcagttttctcattgatacgctgtttcttatcttctatctgagtatggtgcgtcgcctgaaagcggaagtgatgtgggagaacagccttgtgtgctggcttggacgcgggattgagaagacgttccgggaaaggtctgtcacagttaagattttgatgatctttgcgattcatatgatcgtctgctttttcctggcggcgggagcgttttactacagaaatgtgccggcactcattgccctgctcttattcagcgccatggaggcatacattctgctccggaaagcggtggagcactatcagatcctgcagggagttgaggagattgcggacggtgatctctctgccaagattgacgttgaagaacttcacggtgaggaccggaagctggcggagacgatcaacaatatcggcgccggactgttgcatgccgtggacgacagcacgaaaaacgagcgcatgaaagcggatctgattaccaacgtctcccatgacatcaagacaccgctgacatcgattatcaattatgtcaaccttatacagcgcgaggatgtggacaacgagcgcgtgaaaaactacgtgaagatcctggacgaaaagtcccagcgcttaaagcagctcacagaagatctggtggaggcatccaaggtcagttccgggaatgtgaagcttgagatgcacaagatcgacattgtggaactggtgtgccagactggcggcgaattcaatgaaaagttcgaggacaaagaacttacgatagtgacaaagcttccgcgccaggcggtctacatctggtcagacggacggcacctctaccgcgtgatcgagaatctctataataatgtcgccaagtatgcacttcaaaagacgcgtgtctatgtggaagtgcaggcggacgaagaacgtgccgtcttttctattaagaatgtttcggcgcggtcactggcaagagagaacagcgaagtggaagatctgacggaacggtttatccggggggattcctccagaacgacggagggaagcggtctgggactttccatcgcgaagaatctcacgcttcttatgggaggaatgtttgatatttctgtggatggagacctgtttaaggcgaccatcgctcttccgctctatgtggagggacaggaagaaagggggcagtgatatggtaaaagcagtgatctttgatatggacggggtactcattgacacggaaaaatggctgaacaaatactggcgccaggcggcagcggaggcggggtatgatatgacggtggaggatggtcttgcgatccggagtctcgcggcaaagtatgcggcgccgtttctgcaggagcggtttggagcggatttcccgtactggacgatccgcgagcggcgcaaggaactgatgaaggcgcacatcgcggcgaacgggatcgataaaaagccgggtgtggatgaacttctggactatctgcgggcgcatcggattaagacggcggtggcaactgccacagatccggcgcgcacaaaggattatctcaccagaatcggcatctacgacaagtttgaccgtatagtgtgcgcaacgatggtggagaacggcaagcccaagccggatatttatctctatgcctgtgagcagatcggggaagcgcctgcggactgtattgcggtcgaagattcccccaacggcgtgcgctccgcaacggatgcgggaatccggacggtcatggtgccggatctggcggaaccggatgcggacacggcaaaacgcatcgcggcaaaagcgggtacactctttgatatcatactgatgtttgaagacggcgatttgtcatgataaagcgcgaaagtgcttgatttttacctgcaagaccgatataatttttgaaaggctatgataagggcaaggaggaaatcatgaagttatatgacagcggagtatatctggtaaacggaacggaactggttgcggatgacgcgcaggcagctgccgcaataaagagcaggacgggcagagaggtggcaaaagccgaggcggcgcagggaacgatcgcatacggcattttaaaggatcacaatgtatccggcaatatggacaagctgcaggtcaagtttgataagctgacttcccacgacattacgttcgtaggaatcatacagacagcacgtgcatcgggactggagaagttcccgattccgtatgtactgacgaactgccacaacagtctctgcgcagtgggcggcaccatcaacgaggatgaccacatgtttgggctgacctgtgcaaagcgctatggcggaatctatgtgccgcctcatcaggcagtcattcaccagtttgccagagagatgctggcggcaggcggcaagatgatcctcggatcggattcccacacgagatacggagcgctcggtaccatggcagtcggcgagggcggtccggagctggtaaagcagcttctctccaagacatacgatattgatatgccgggcgtagtcggcgtttatctgacgggtacaccgcgcaagggcgtcggaccgcaggatattgcactggcgatcatcggcgaagtatttgaccgcggttatgtgaaaaataaggtcatggagttcgtcggaccgggtgtttccaacatgagtgtggactatcgtatcggtgtggacgtcatgacaaccgagacgacctgcctttcctctatctggagaacggacgatgcggtgaaggagttctatgagattcacggcagagcaggagattacaaggaactgaatccggcagcagtcgcttactatgacggaatgatcgaaatcaatctggatgagatcaaaccgatgattgcgatgccgttccacccgagcaacacctacacgatcgaggagctgaacgcaaacctgatggatattctggatgactgcgagaagcgggcagaggtaagctttgacggtgcggtcaagctcgacttaaagagcaaggtcagaaacggcagactgtatgtggatcagggtattatcgcaggctgcgcgggcggcggttttgagaatatctgtgatgcggcggacatcttaaagggtgcgtcgatcggaccggatgagtttacgctcagcgtttatccggcaagtacgccgatttatatggaactggtgaaaaatggagccgttgccacgttgatggagacgggtgcgattgtgaagacggcattctgcggaccgtgctttggcgcaggagacacgccggcgaacaatgcattttccatccgccactccacgagaaacttcccgaaccgcgagggttccaaggtgcagaagggacaggttgcttccgtggcgcttatggacgcgcgttccatcgctgcgacggcggcaaacaagggatatttgacggcagctacggacgtggatgtagatttttccaagccgaagtatcattttgacagtgcgatctatgcaaaccgtgtcttcgacagcaagggcgtggcagatccgtccgtggagatccagttcggaccgaacatcaaggactggccggcgatgagtgcgcttccggagaatatggtattaaaagtagtatcggagattcatgatccggtaacgacgacagatgagctgattccttccggcgagacctcttctttccgctcgaacccgctcggattggcagagtttgcactctccagaaaagacccgcagtacgtgggacgtgcaaaggagatccagaaggcacagaaagcagtcgaggagggcacatgtccggttgaggcagtcgaagaactgcgcccggtaatggatgcgatccgtgcggcatttccggagaaaacgtttggcgaagagatgaagccgggaacacttggcttcggaagtacgattttcgcggtgaagccgggcgacggttctgcgcgtgagcaggcagcgtcctgtcagaaggtgcttggcggctgggcaaacatcgccaatgagtacgcgacaaagcgttaccgctcgaaccttatcaactggggtatgcttccgtttgtcattccggagggagcgcttccgttccagaatctggattatctgtttttgccggacatccgcaaggcagtggaagaaaagcagagcgagattaccgcatacgtggtgaagggttctgagttaaaggaatttaagctgggactgggtgcgatgacggacgacgagagagagattatcttaaaaggttgtctgatcaattattatcgcggataagcccgtttcgtggcaataggatcagagagaacaggcagtgttaagaaatgcactgcctgtgtttttacagcggagtttgttttaactaaccaaaaagtttattttgttgtaaatacaacagactaattcctggtaccatggtaggatttggaagaaatagaaaacacggggttgtgtaacaatagaacatagaggaaaacgaccgcgtgtgtgaaatagaaaggagaaatgaatgatgatgaatccaagaaaagttgcagtaatcggatgtggttttgtgggggcgtccatcgcgtttgccctcatgcagaaaggactgttttcagagatggtgctcatagatgccaatcacgcaaaagcggagggggaggcgatggatttaagccacggccttccctacacggcgtcgatggacatctatgccggggactataaggatgtggcagactgcggtctgatcattattaccgcgggagcgaatcagaaaccgggagagacgcgtctggatctgatcgagaagaatgtcggaattttaaaatcaatcgttccgcagatcacggcgacggcgttcgagggaattttaatgatagttgccaatccagtggatgtgctgacctatgcggcacagcagatatccggttatccggtggagagagtctttggctccggtacggttctggatacggcgagactcaaatatcaggttggcagacatctggatgtggacagccgcagcgttcatgccgttatcatcggtgagcatggcgacagcgaacttccggtatggagcggggcgaatgtgtccggaatcgatctgaatcatttctgcgaactgcggggacatttcaaccacgaggcatccatggagcgcctgtatgaggaggtgcgcgacagcgcctatgagatcatagagcgcaagggtgcgacctactacggcattgccatggcggttgcgagaattgcagagagcattgtgaaggatgagcatgccgtgcttccggtgtcggtggaactgcagggagagtacggtctgtccggtctggcactcagcatcccgtcggtggtcggcaagaacggaatcgagaaggtgcttgagattccgctcaatgagaaggagaaaaatgcacttcttgcgtcggcagaccagctgaaggcagtcattgaaaaattaacattaaattagcggcaaataaagaatagcgattggaaaacctccctgcatggggtataatgtacgcataggcaaaagtgagcatgcatcgaaacggatgcagatgcttgcagcggcagccggatccgatgcatgtgaacgcgtcagcgggtccggaaaaccgtaggtttttcggaccttttgccgtaggcgtaagaaaagctgatagggcgaacgcccgcgagtccggaagagcgaagcggtttcggacgtgcactgcgagagcagaagcggcagacaacagaggaacagcaaggaggtttactatggacagtgagagacgacagacagacaatacttccggcgacagaaatggcggatggaatttaaagcaatatgtagtaatcgcgttggtagtgtttattacgttttgctgctgtatactgtttttctttatgatatatcgttacaacgggtttgcggatttctggaaaaagctgaccacaattcttcagcctattattatggggctggtgcttgcatatctgctcaatccggtaatgaagtttctggaacgtcatctgatgaagctgttggaaccgcggatgaagagcaaaacaaaagcaaaaaaaatgtcgcgcggcgttgcgatcgcgggggcgtgggtgttcttagggggaatcgttgtactgcttatcgcggcgattgttccttctatcatacagagtatacaggggatcgccacggggcttccgagcgaggtcaagaacatcatggactggtcggatgaattcttcaagggagattcggagattgtaggtgttataaacgatgtgctgcaaaaagcaagcgatgccgtacagaagtttcttgaaaatgatctgctggcgcaggttcaggtttatctgacgtcgatcgcaagcggtgtgatctatactttaaagtttctgctgaatctggtggtcggcatcattgtgtccatttatgtgctggcgagccaggagacgtttgcaggacaggcgaagaaaatcatttacgccatgttcaagccggtacgtgcgaacgtgatcgttgagacggtgcgcaagagcaacgaaatctttggcggatttatttccggaaaacttctggattcagcgattatcggtattcttgcctatgtggtgctcactattatgagaatgccggatacgatcctgcttgcagtgatcatcggcgtgaccaacattattccgtttttcggaccgtttatcggagcaattccgtcattccttatcgttgtattgcagaatccgctgcagggagtgtactttctcattttcatctttattctccagcagatcgacggcaatattatcggaccgaagatcctcggcgattctactgggcttagttccttctgggtggtatttgccattctggtatttggcgggctgtggggattcccgggcatgctgctcggtgtgccgctcatggcagtaatctactatgtggcacagaagctggtatcttattttctgcgaaagcggggtctggtggacgatacgggaagctacattcatctgatgcgcattgacaagaggacaaacgagcttgtctatgaggaaaaaacggagaaaggcaccgaggaaaaaatcgaagaatcacctgaaaaataatatgctgccctcatataggacaatgaaatataaaagtcctatatgggggtattttcatgtctggaaaaagtaagataattccaataaaaaaagacaggcagcacaccactgcgtgacagccttttcggacgaatatttttgacatctattagtgcgtatgataaactaaaaggtaataaaaagagtgaaaatcgcacagtttgaggtggcacaaattggataaatacgaatataaattaaagctggatcagatgaagtcctttaccgcagagaataattacaaagccgctgcggagattgcggacacgatcaactggcataaaataaaaaacgtcaacgcactgattaaggcgggagaaatctacgagaatgtgggaagatatgaggagagcagggacattctgctcatggcgtatgacagatctccgatcggacgaatgattatctaccggcttgcggaggttgccatcaagatggggaactgcgaggaagcgagagactactatcaggaattcgtggagatcgccccgcacgacaatctcaaatacgttctgcgctacgagatcagtaaggcggagggcgccgatctgcagacgctgatcggaatactggaagaattaaaagagcaggaatattccgaggagtgggcgtttgagctggcatgcctttaccataaggcggggatgagcgaaaaatgcatcgacgcctgcgatgagttgattctctggttcggagacggaccttatgtggagcgggcgctggagcttaagatgctctatcagccgctgaccagacagcaggaggaaaagtaccggcagttccgcctcaaaaaagagggcgttgtggaagtgcggccggaggacgaccttgagtccggcgagattgtgagcgaaccggtgcagataccgaaggtaaagctttcaccggagcgttttaatacacagaatctgcaggatgaacttcgcaagaatatggtgcagatcatggaagcgaccgacaaggaaaaggtcgaggacagcatggatacgatcaagaagctcgtggaggagattccgtatcttcagatccccaaggaggaaccgttgccgcaggatacgatcgagatgccccatatcgagacggatgcagagattgacaactcgctcaagagcaattttaaagagcttcttgcagaggattatgacggacagatcagcatgtatgttccggataagggggctacagagccgcaggtgacgggacagatgagtattgatgaggtgcttgcagactgggagaagaccaagcgtgcggcagagacggcgcttgaggaggcgaagcagcgcaagctggaatccgcgaaggcgcgtgcactgcaggaggcaggcgatatcatggagcgtctggtggatgtgattccgaagcttgactccggactgacaccgaaggatctgctggatgaagagtatctgggcggccagccgattgctgacgataaggcggctgagatggtggcgaacatgaaccagatcttacagcaggagatcgaccgcttatcttccgagaatgcgagaatggatgaacagcttgcggcggcaagtgcggcggaggcagcaggtgtggcggagccgcaggaagcgttgcagccggaggaggcagatttctgggggaacggcatcacagagctgacacagagcccgtatgagatagaaccaggtgcggagcagcttgcggcggaggctgcatatgaaccgcagacagatgcgggatacggagcagagacagagccggtatatgcaccggaggcagaggcggtatatgagccgcagacaggggcggtatatgaaacgcagacagatgcggtggtaagtgagacggaacaggcagatgcggcaggaagctatggcggaatcgcggaaccggagattccgggcagctataccgaagagacagacccggatacgtttaccctgggggccgatgtccaggcgcttctggcagaggaagcggtggcaaaagacacggcgcagccacaggcggcggaagaaccggaggatacagacgatgctgccgggatggaagagccggatacggcagcactgggagccgacatccaggcattgatggaagagcagaagatacagccggaggacgaggaacttccgaaggcggagaagtccggcggaaagctggcaggcgggggacacccgaagagcggagcttcaaaagcgaaagcggcagacgacgtgcttccgaagatcgaggagccagaggaggaaggacatcaggcaattacccggctttccaaagagcagcgggagatttttacatattttgtgccgattaagggaatggaacagcagctgtgccaggcgcttacgggagcagcggcaagactttcgtccggtaaaacggcttccaccgggaatatgattattcagggcggacagggaagcggcaagacggtgctcgcgaccagcatgattaaggcgctccagaaggaagtgggcaagccgaacggaaaaatcggcaagatcgaagcttccgtgctgaatcagaaagatgtggcggcgctccttaaaaaagtggcgggcggatgtctgattatcgaaaaggcgggagccatctcaagagagacggcagtcaagcttggcacgctgcttgacagtgacaacagcggattgtttgtgattatggaggacaccagaagaggaatcgagaaggcactcagccgggatgcgggatttgcagcacggttttcggagaaaatcaatatcccgatctttacgagcgacgaactggtggcgtttgcgagatcctatgccaacgaactgggatacaccatcgatgagatgggagttctggcactttacaacagcatcagcaatattcaaaagctggatcaggcgacaacccttacagaggtcaaggatattgtggacgaggcaatcgcccatgcagaacggggaggacttaagaaggcgttcagtattatcacttccagaagatatgacgatgacgattatgtcatccttcatgaaaaagattttggattttaaaatcaagataaaggggtagatgggtatggcaaatttttcagagctggatcggtacttatttgggcaggcgacacactatgagatttaccggaagctgggggcgcatcccacagatgaatacggcatccggggagtctgctttgatctgtgggcgccaaatgccgcgcgtgtatgggtcatcggttcctttaacggatgggatgagggcgccaatgaaatgaagcgcctggagccggagacgatggggatttttgaattgtttattccgggtgtcgaggagggcgatctgtacaagtacctcatcgagacgaaggacggaaagcgcctgtacaaggcagatccttatgcaaactacgcggagttaagacccggaacggcgtcggctgttgcggatatcgaacattttaagtggtcagatgccgagtggatgaaagagcgcgccacacacaaggaagatgtatatgaacagccgcttgccatctatgaggttcacccgggatcctggatgcgtcatccgggcagacaggatgacggattttacagttatcgggatctggcaaaatctttgattccgtatgtgactgagatggggtattcccatatcgagcttatgggaatctgcgaatatccgtacgatggttcctggggctatcaggtaaccggttattatgcgcctacctcgcgctatggaacaccggaagacttcgcttattttgtaaatgaatgccacagacacaagatcggcgtcatcttagactgggttccggcacattttccaaaggatgcgcacggtctggcagagtttgacggaagctgtctctatgagtatgcagacccgagaaaaggggagcatccggactggggcactaagatttttgattacggtaagaacgaggtcaagaatttcctgatcggcagcgccctgctgtgggtggagcattaccatgtggacggtctgcgtgtggacgcggtggcgtccatgctgtatctcgattacggaaaggaagccggtcagtgggttccgaaccagtatggcgataataagaacctggaagcaatcgagttctttaaacatatcaataccctggttctcggaagaaatccgggagctgtcatgattgcggaggaatctaccgcatggccgaaagtgaccggaccggtggaggatgacggactgaatttcagctataagtggaacatgggctggatgcatgattttttggattacatgaagctggatccttactttcgacgggataatcatcacaagatgacatttgcgatgagctacaatgagagcgaaaaatacattctggtgctctcccacgatgaggttgtacatctgaaatgctccatgattaacaaaatgccgggacttggcattgataagttccgcaatctcatggcaggctacgcgtttatgatgggacatccggggaagaagcttttatttatgggacaggaatttgcacagcttcgcgagtggagtgaggagcgcgagctggactggttccttctcgacaatccggatcacaagcatatccagaactgggtgaaaaaactgcttcatatttaccggaagaatccggcgctttacgagctcgacagcagctggggcggtttcgagtggatcaatgcgaacgatgcggacagaagcatctacagtttcatccgcaagagcaaggacggaaaaaatcagctgctctttgtgtgcagctttacaccggtggcaagaccggattacagagtgggagtgcctgccaagaagacctacaagctgatattggacagtgactccgaagagtttggaggatgtagcagacagcgtccgcagagttacaaggcggtggaggccgaatgtgacggcagaccatactcgatcgcgtatcctctggagccgtacggcgtggcggtatttcgttactgattgcatttcgggggctggtgaaatgcgaagaacatcttaataatggtgctgatatgaccgatatatatatcagctatgaatggcgcatagtgttatgcgccatttttatgcttcatattcgattactctatagaaccacagctgaaaaggtaaaaggagtgcacaggatgagagtagagcagcagagccagaatattatagatgttgtaaagcagagtatcggaccggaggaaaagagcggggccgttctgagccaatataccacaggagccgcgggagctgccgtggaaaaaagcagtgtcagtgacaatgcgaaatccgtgaatttaaaagatgccacctatgccaagccggcagcggaagacaagcagacggttgccgaggagatcgaagcgtccgcgacgcttgatgtcgaagagcgcaagaaccagatggcggtgttgtccaacactacctccccggaagattatgcgaaaatgcaggaagacggattttcactggacgatacgacgaccaatacgattgtgaccgagacggataagattaaggcacagcttgcaaaagcgggagtggatatctctttctttggagatgatctggattacgagcagatggcggcgattaccggaagcgaagcgcttgcaagacagctggcgcaggcaatgaaggaagccgatctcccgtgcaccgaggaaaatgtgcggggcgtgatggaggcgctctcactggcgcagacacttcagacgccgggggacggcgcagtgaaatatatgctggataacgggatggagcccacgatcggtaacctgtacaaggcagagtacagcggaagtgctgcttatcaggcaaatccggaggcagcagtcgatatgacgatgttttcggatcagattgacgcgattattgcgcgcgccgggctttcggtggatgatacatcaaaagaggcgtgccagtggctgctggacaatagcgtgccgctcaatgaggagaatcttgcttactatatggaactgaaaaatctcagtctgccagtgcaggcagaggcgctgctgggcagtatggcggctgcggttgcagaaggaaaaagcccgcaggaagcactgcttgtggatggacaatcatttgcggacaaggcgcaggatgcctgcgatgtgatcggcgaagcgacggatgaggatgtcgcatatgtcgtggatcacggcatggagttaaatatccgcagcttaaaagaagcgatggcacatcgctcgggtgaggagacggcggatagcgcttcgggagacgcgcaggaggagacggcagagagcagtgcggatggcagcactgcttatacacagagagaactggatctgctgaccgccagaagacagctggaggagacacgtcttgcgatgacagcacaggcaaactatgcgttgctcaaaaagggaatccagattgatacccagccgctggcagagcttgtggaggctttgaaggagacggagaaccaatattacgaacagctgttgaagggacagggtgtagaagcttcggagacgaacgtgaatcttttccgtgagaccacagagcgtgtcaacgatttaaaaacggtaccggcatacgtgctgggagcgcagggagtaaaggatgcgtctgtcgcagaggttcatgataccggacgtgcgatgcgggatacctttgagcgtgcaaatcagagttatgagaccctgatgacggcaccacgtgcagacctgggggattcgattcagaaggcattccgcaatgtggatgatattttgaacgatatcggactggaggcgacggaggcaaatcagcgtgcagtgcgcatcctcggttataaccagattgaaattacacaggaatccgtggcggagatgaaagcggcggatgagcaggtgcagcgtgtattccgcaacctgacgccggcaacggtgacggagatgatccgcagaggaatcgatccgctggatatggattttagtacgctgaatgcgacagcggagcagataaaaagggagactggcgcgaacgatgagcgcggcttcggagaatttttgtggaagctggaacgcacggagggaatcagccaggaagagcgggcttcttatatcggaacgtatcgcctgatccatcaggtagagcagtcggacggcgccgcggtgggagcacttgtaaatcagggagccgatatcaccatgcgcaatctgatgatggcggtccgatccgagaggcgcagtggaaaaatggattacagtgtggatgaatcctttggaaaagtggaaggcagtggatattccggcacttccatcaccgatcagatggaagcggcatatcagaacaactgcgtgaaagatgtcgcagatctgctcacaccggagcgcatgaaggttgtcgcatcacagacgccggactgggaggagatgactccggagcagttaaaggaggcgctcgcgcaggcacagacagacgatgccagccaggattatgcatatgcgaaggagcagctggatcagttatcgcagagcgcgaaaatgacgcaggatatttacacggtactgcagaagtacgacattccgaataccatgacgaacgtcatggcgatggaagccatggtaaatgaccggaacggcgtattccgccagatcttcggcgagagcgcaaagggaagccacaaagaggaaaatgaggagcagcttgcccgggcgaaggagcaggtgcttgaggatttcggagaggcaatcgcaagcccggagggacttgccgccgcacaggaacagcttgctgaggttgccgagaatgtaatgaagggaatgatcgacagcgatgacgtgacaagccttgatatcagggagatgcgtctgttgtcggcacagttatccatcggcagtatgatggcaaaagaagagcagtatgcaataccggtgcagaccgagagcggtgttgtcggcatttcgctaaaggttgtgcgcggggatggtgaaaaagggctggttgacatcacgatggaaaccaagcttcacggtaagattgcggcaacgttccaagcaaaagagcatggcgtcagcggtctgattgcatcggaccgggaggataccaaagaacttttagacagccggcaggagagccttacggcagtattggacagtggaaacgaggcagatcttcactatgcatgcatcgcagatctggatctgaaccatttttcaacaggcgtctttggcgtggatgcaccagaacagcaggagaccacagagaaacagtcggatacgacgtatcaggtgcagacaacaaggctataccatattgcggaaagctttgtgcggcaggtgcaggatcttttgcagggaacagatgcgcagggagcggatgcataaaacagttatagcagggattcttcttcgagataggagagaatccccagatagatggcatgagcaagcttgctctgataatcttcggtcaagagcagatcggcttcgctctggttgcttaaaaacccacattctacgattaccgtaggtgtgggtgttttttttaggagatagtagctttcgtttgccttggcgacgcgtgtattctggggatcgacttcagagatcagatgttcctggagaacgtccgctaagcgcttgccgttttcggactgcccgtaatagaatacctgggcgcctttgatgtcttcggttgtgtagctgttctggtgaatgctcacggtgaaagcgggattggcgtccgcgattatctggcagcgcttctgcatatccgcggcttttttgttggtggcgtctgcgggtgagagaccggcgtcggaatcacgggtgagaacgacagagatttctctctgttccagaagatcttttaattttaaagcgatggagaggttgatgtccttttcgagtgcgccgttgatgcccacctttccggggtcacttccgccgtgaccggcatcgacgacaatacagattttttcacgtgccgccttttcactctggaccagtacggcgccctgctttgcgagaatgaaggcagcggccagaagacagaggctcatgataagttccaacttttttttcatgaaataaaaaacccccggggattcgttcataaaatgatattcacgatccccgggggttagaacggctagttgatgtatttgataatggtatcccagacagccggatcctccagaccaagcttccagaaagctccgccggcgagctggttggactgcattacctttaacttctcctcaagtgaagtggcatcctccacccagatcttgtaggtgacgccgccgttgatgtattctacataatactgtccgtctgtgtcggaccacaccggaacggctccgttcgtgctgatcaggttctggacttctttcatgcctgccgagtagcagtccagctcgtagagtgtatcactgtcggaggtgtcctcggttgtactgacagccgcgccatcgtccgataccggagtctcgctccagacacgtgtgtaaaacggcataccgagaatcagctggtctgccggaacgctttggagcgtatctgcgacaccctgattgacaaaaccgatggacgccaccgatccggcttcctcggaacctgcgtaatgctcatcatatcccatcagtatgacatagtcggcaaagactgcctgttcggagcggttatagaatgccgtgtaagctgttggcggataattatcgacggaaaggacaatgccgttgttggcacatttcagcgataattcccggataaactggatataggaatcaccgatggaagggtcgagcgattcaaagtccacgttaatgccgtccagcttgtactggatcgcagcggagatcaggttgttgatcagactctcacgtctggaactgtaggtcagcacctgcgtggtatccggactctccagtccctgatccttggcgccgaagttgcttacaagcgcccagacttcaatgttgttctggtgacaatagtttacataatcagaacttgccagggaaccgatgcctccgttcgtatcctttaagtaaaaccaggtcggagagatgacattgagtcccttggtgtttgaaagtacgttcgcaatgtttgcgttcgcactgctgttggtcacctgatgccagccgagattgatggagaaatcttttttaatatgcgaaaattcttccgcagtgtagtcgctggtccgggtcgcggtggaagtgctgccgagggctttggtctttacatagccgatgatgccgtcctccgtcatcaccttcgtccaggtctcgtccggctctaaaaccgtgagcacggttccttttgcaaggtcggcgagaatcggactcttgatgccgccctgatagcgcagctccgtggatttcttgacaggagcggtgttgtagtcgccccactggtttgtgaggacaacgcggttcggctgatcgtatacggtataatcaaaatcggaatactgttttacgaaatcgatcgcaatatatgcggtggaggcatctgcctttacaatcgtgtgatctaacgtccgggcgtctttggtcacatagtaggtcgtgctctccgcatccgccgagatcaggtcggtggcggtggtgtataaaagcttgttctcattggcatcccagaaaaaacggctgttgatcttatcgtgaaccgtctcaaaatccagatatacgtttccgtcgatcagtcgcccctgcacagacaacacttcattattaaagatcagggctacggaatcatcagatgcaagcccgtaatactcggataactcctggtgttccttggagggcgtgtatttttcgatcagtcgcccgagcagcatgaacagaatgataatgacgattaaaacaagaacggcaatgaccggtataatattcttttttgtattcttcatggaaaaaccctttcttcttctgagagatttcccctacattgtagcatattgcagcacaaaatcaaagctatttgcatctgccattttttgcgtgccgcagaatgaaaaacgggaaccggccgcaggagattgtgaactcgggcggcagttcccggctgtctttttatcaaataatattcactgcatagacagtatgaccgggcattgaggaactcagtcattctgttccagttacgactagttacggaagatcttttctgatcttatcaaaatggacttcctttaacaccccctcgtcaaaaatataatctctcatgtacgtgctttcctcctgcacgcagagctggctggctacatcctgcgagctgcttttcgcgccctccagccagatggtaatgcctcgattctccagagacgtaagctccagatagagtctttgcatatgttcatcattcacattagattcccccaaatctgaaaaataccaaaaggaattcgctggttacgtttcgtgatataaaaaagatggatctgtctgatccccggcagacagtgtgttgcggttacaatgaataaaatgacagaagtatgtcaaaaaatagaaagtgctccttctctatatgaaaagggtttttgatgaacggaacctcctgcatggatatggagtgctgcctggaaaaaacggaatgattctggaatgttcccacctgtaccagataatgataaccttccccaaggtttgtaaagttgttaaattgtttgaaaaattcctcataactccaggttttccagagtgcaagactgcctagcacaatcttgcggtcacagcgcaggaattctgcggcagcagattcgtttaagctaccgagatccaggatcagataatcataccccatattcagcaggcgcggcacagcatccggcgccagattcggataataatccacgccgtgcagacggaagtgaaaaaactctgcctttgaagtgtccgcggtatccgccgctttgctgcattgtaaggcatggcggtgtatggagtccgcaagagcagattccggaatcagccgcgccagttcgctgcgcttgtgaagctcaagacaagcggtgcgcagtcttcgcctggaggcacagtatgtgctaaggcttatggcgagctgtgtcacgccagcccccggatgacatccgagaatgccgatggtgatgtgtgctttggtttcgttgcgatcaaaatagaagatgccgtctccctcctttcttcggtaagatggacgaaacaagccgttccttttcgggtgttgtatcgtatggaaccgcatcttccggaaagcagtagacgcggtgacctaactgccgtgcgtatgcctttgcggcagagcggcagccgtgattgcagagaaaacgtgtctgtggcagcagtgccagctgtttcccataggcggctgcctgtacaaaatcccagtctcctccgtttaagacgaaaagaatcaggtcaaaagaagccagctcggcaagcgcgggcgcgcgggtgccatagtcccttacaacgcagtcatccggcggaacggaaacagatacactgtccccatagtccggaatcccgcggaagcttccataaataaagatcccgttctggtcgatcagacgatgatttgccctggcggcgtgtagaagcgatgcgctcccgtccgcggcagcatagattgcgggaatatgtttttgattcatggtgctgacaagagaaatggaaatatgcgtggcgcctgcaccgggtctgctcccgatgacggcaatgttccgaatgagatgcgaagactgctgattctctgataatggtacacgaagcagtgcggctttcagatcgcaggcctcctgacagcggtctgccggatctgcagcgcacgcctgctctaagatgtaccgaagctgtctggaacagcggcaggacatggcgtccgaaagctccgttaaaaccctgccgagactgtagatgtcggcggccggagtgacgggctgtccgcgcaggatttccggtgcgcagtagcggcttgtcccgtaaagttggaaattttttccgaaaccggtaaaaaaagatgcaatgccaaaatcgagtaattttacctgatctccacataatataatatgctccggctttaagtcctgatacaggatcgggtatggagataaatgatgcagataggtaaaaatgtcgcatagctgtatgcccagttttacgatcagttcctcagaaatgcttttttgatgagagacaaacgtctcgagtgattcaccctgaatgtattcttcaatcatataaagataggcgtcatcttcgtcgatatcatatatgagggggattcctggatgattaagattcttcagaagagctgcttccgcgaggaagtcagattccagggagaaagaagatctatctgacagagatctggggattcgcttgatggcccgataaatcttcagcttgagatgctcggcgagaaatacggtaccgaaactaccggaaccgagtacggaaagaatccggtacttgccgaacagaataacttcttctatgcaaaatccgctcctttcatagtgtggcagattcgcatctcatgcatatgtttataacatgaaaaatgtagtttgacaatagctttttgacagtttataaagatttaataaaaaggtatactttacatcaatatagcatttgattataataaatgtacagtttacaaggttttccggataaaggaagtaatgcgggagtttcgcatgaaagcttggctttcagaatacggaaaggcgtggtgtagtatgaaaattgaaaaagtaaacgacaatcagattcgctgtacgctgacgagggaggatctggcagagcgtcagatcaagctgagtgagcttgcatacggaacggagaaggcaaagcttctgttccgcgatatgatgcagcaggcggcgtatgaatttggttttgaggcggatgatattccgctgatgatagaggcaataccgttgtcacaggacacgatcatcctggtgattaccaaggtggagtatccggaggagcttgataccagattttccaggttctccgatccggatccggaagacgtgtacgaggaggcaatggcaggcggtggagcagcaccggcgccggaaggtgcagatgacatactggggttgttccgcaggattcaggaagagcgcagaaaggcggcagatgcacagggcagtaaggatagcttcgtttcagaagagaatgataagaaaaaagaaactccggtaaacgtacttgtagacattacgaagttatttgtgttcagtgatttttctgagataaccagactggcgaacacgctgcagggcttctatcaggggaataacgatctgtataagaatgaggcggcgcacaagtattatcttctggtcagcaagagcagacagacaccggaagagttcaacaaggtgtgcaatattttatccgaatacggaacgcagcagacgtatacgccggcagcaggcgcgttcatgaaagaacactatcaggtgattttgaaaaatcatgcgcttcagacgcttgcagagctttaagggtcctgcggcgttaagcaacagaaaaaagggtattccggttccagtgggaaccgggatacccttttcgtctggtgtctgcctgcggattaagcgagatcctttgcaaggaaatcgttgatctcttttaccagagcgtccggatcgataccgtgtaccatggcagcctcttctactgtctccatctgggaagacgggcatccaaggcagtgcattccaatatttaaaaggattggtgcgatattctgatcgatctgaagtaattcgccaatcatcgtggactttgtgatctgtgtcataatgatacctccttatgtgattatgggcatgtatgattacattagtatgcccggcaatgtgctaattataatacgaaacgcggcggaatgcaaacaaagtttgcgtgaaatacacaggagtgcgggaaatcttttctgccgggtattcagtgaagcggcaagttggtcgatatataggacagatatggataaaggagaacgacaggatgagaataaattataatgtttcggcatcgatagcgaataagaatctgctcgggattgagagtaatttaagccagtccatggagcggctttcttccggtttaaaaatcaatcatgcaaaggataatccggcgggaatggcgatttcccgcaagatgaaagcgcagattgacggacttgaccgggcatccgccaatgcgtcggacggtatttccgtcattcacatttcggatggtgcgttaggtgaggtgacaaatattctgcagcgtatgagagagctttccgtgcaggcggcgagtgacgcgacgatgggtcaggaagacaaggaagctattcagaaagagatctcatctttaaaggatgaggtggaccgtatttccaaggataccgagtacaatacgaagacactgcttgacggctcgctggacaccagagtgtacacaaagcatgccagccgcatccaggtgacggatcaggtgagtccaggaaattacgagattaaagtcaaaacggcagcaacacaggcagaggtgacgtccggtgcagattttaacagcacggcggcaatcggcgtttccggcacgatgagcgtcaatggatcaaccgttgagatcgcggcaaccgacacgtatcaggaagtatacgaaaagctccggacggctggagagatcggcgagacacagatcgagcgcagcaaggcggacggaagcctgacattcactacagacgcttacggatctgacgccacattgaagctttccttcagcaatcaggcgcttgccaatcagtttgcactgtccgacgcatccggcaataacggtctggtgcaggatccggcgacaaaacagtggatttacggaagccagcagacagatgcttccggcaagacgacaacgagtgttccgaacggatcggacatggaattggatgacgtggcgaactggaagggatttacctcttccgcgaccgcaaagtgcgacggtaaccgtgtgaccatcacggatctgggcggtttttccctctcattcctggtggaagcaggatatgaggacggtgcgaccaagacagattctgccggcaatgtgttggagacctatgacggatccctcaaatttgaggtgacagatatgggaaccatgacgcttcatatcggtgcaaacatggatcagaatatgaacatccggattccggagatttcctgcgagagcctctatatcgacgatctggatgtgacgacggtcaatggtgcagaccgtgccttagaccgtctggatgatgccattgcaagagtcagcgaaacacgttcaaatctgggagcctatgagaatcgtctggagtattccacaaacagtctggatgagtttggggagaatatgacggatgcgatgtcgagacttacggatgttgacatggcggaagagatgacgaactatacacatcagaatgtgctcaatcaggcggcaatttctgttttgacacaggcaaatgatctgccgcagcaggtactgcagattctgcagtaggcgcgatgaggcatgagaacggaggtctgtcttgaaaaaagaacagattgtagattttaccaggcggatcagtcaggcgaaccggagcggactggtcgtggttatgtatgatatttttttcacatatctggatgatgccagggcggcatacgatgcagccgactgggatgcctacaaagaagcattgcggagagcgcagcgcgcgatcgatgaactgatatcggcgctcaatttctcctatgacatggcgaagaatctctacagtatctatgtgttctgcagagattcgatcgcaaagtctctctacaagagagatctggcagatgccgaggatgcctgccgcctcatgaaaaagctctatgacggctttgtgcatgcggccgagcaggatcattcggagccgcttatgaaaaatacgcagcaggtgtatgccgggtatacttacggacgtgacaatctggtggagacttgtcaggattccgatagttccagaggatttttggtataaaaatcctctggatttttttgtgtgcgcaactcatagttgcggatgcttgtaagaagaaatttgtagcgcatctgcacggaatttaattcataaatgtaacagtcgatcagatccggatcgatgacgttttccagattgcggtaggcgtcctgcagatcctgtgccgtctggtgcagatcgtttatcagcagcgtataatgattatcattcgttttttcgggttgaaaaaaacgcagcatagttcctccagatctatgggttctgccgaagtctgcggcagtgttgttccttctatcttattcaaagtataagcaaataaatcccattctatacaaaaaacggtaaaaatctgtccgtccgccggaacagacaaactggcataaacggacgcggacattcatagatatagaaaaaagtgtggaggaaacgccatgcaggaaatgtcgctgacatcattctggatcattgcgggaagctgtgtgctggtccttggaattatgatattaaaaaatcgtgcaaggtttgcattaaattttctggtgcgcgcggttctgggtgcctgcgccatcgcatgtgtgaacaaatggctcgcacagcagggaatcatgcttgccgtcggcatcaatccggtgacccttttgacaaccggaagccttggttttagtggggttgcgcttctttatggaattttgctgctcaaaattttgtgagaatcttacaaatgtaaataaaatgcgaaaaacctatagacaaagcaaaaatgaattgctataatccgatttacaaatgaacgaaggggtggtgagttggggaacttatgacactgacgctgttgacggtacttgcatttgcggtcgcagcggacttccgggagatgcggatcagtaaccggctgattgcttccggacttatgatgggacttgcactgcgcattctgggggaaggcggtgcaggcattgttcatttcctggtgaacatttctattccggttatcttattgtttcttttatttcaactgcgtgtaattggcgcaggagatatcaagttattttccgtagctggtggatttctttcaatgagacagttgttatatgtcatactggcggcatttgtgacggcagcagtaattggactggggaagctgctgtatcagaagcgaatggcgggaatattcgggaatcagagaacactgattcatttttcagcgatgattttaattggatattttattgtagtctgggggtgtgccattgaataaaattgcggtggcagtctgtgatacagaccgggaataccgggacagatttgtcacatacctggtggaacgcaaggcggaagaatatgcagtatccgcattttcgatgccggagaagcttttggaagcgttggaggaagagaagccggatcttgcgatatgcgggaccggatttgaagagatggcggagagactggcgggatacgatattccggtgctggtcttgcaggagacgatggcagatgcggttgcggaatcggtaacgtacggttccgtgccggaaagctgccgtggaatctgccgttatcagtccatggaggtcattctgcatgaggtgcaggtgatgactctgacgggagccggcagcagaaggatggagaatgtcggaacgggaatggaggtaattggtgtttattctccgatctgccatgaaatgcagatgccgttttcgatggttctcgcacagaagctgtcgacggagaagaaggtattatatgtgaatctgatggaacattccgggatgctggagctgcttggcgttccgggagaatgtgatctgggcgaggtgattctcgcattgcgcaggcagcgccttacggcggaaacgcttggcagagggattcatgagaccgagtggatgcactatgtagaaccgtttgataatccggaggatctgggggagatgaccgcgggggatctgcaggaactgatctcctttctggagaagcagacgtcatatgagatcctcctgttggattttggtcaggggttaagggattttctatcctttctggggctttgcaccagtatttattgtccaatgaagagcggcttttactacgactgccggatggatcatttccgcagatacctggaaagagagcctgcggtggacattgcagaccggatgcaggtgataaggctcccgttttctgcaggaaagatacgtgcgggaatggatgtgtaccgtcagtttttgtggagtgaatttggggactatgtccggaaccatatcggtggacaggaagaataagaccgggacagggggatgcgcaatgcagattgcgggagaagagatagaacggctgcgcagacagatcatggagcagatcgacctgacgcggacggtggaggatgaggaggtatatcagctgatcgaagcacaggtaagggactttgccagagagaggatgcttacgctgggggagcgggaagctgtggtacagaccttgttttattccctgcgcaagctggatgtactgcaggaactgctggaagatccgacgatcacggagatcatggtaaacggtgcagaacatatcttctacgagaaagcgggacggctgtacaaagcggagtacgggttttcctccaaagaaaagttaaatgatgtgatccagcagatggcaggatacagcaaccgtatggtgaatgaggcatctccgattgtcgatacccgtctggcggacggttcccgcgtcaatattgtgctggagccggtggcgatcgacgggtcggccgttacgatccggaagtttccggaaaatccgatcggtatggaggatctcatccggatgggaagcatctcacaggaagcggcagatctactgaaaatactggtgcggtgcggctacaatattttcatttccgggggaaccggttccggaaagactacctttttgaatgcactttcccagtatattccccgcgaggaacgtatcattacagtcgaagattcggcggaactacagcttttggacaagccgaatctagtgcggcttgagacgcgcaatgccaatacagaaggcgttacgccgatcacgatccgcgatctgatccggacggcgcttcgcatgcgccccgagcgcattatcgttggggagtgcagaggcgcggaggcgctggatgtattacaggcaatgaataccgggcatgacggaagtctctcgaccgggcacgccaactcgtgcaaggatatgttaagcagattggagacgatggttctgatgggcatggaactgccgcttcccgcgatacgcagtcagattgcatcggggatcgatatcctgatccatctgggaaggctgcgggataaaagccgtaaggtattaaaaatagtggaaatagcaggaatggagcagggcgaggttatgctccatgaattgttcaggtatgaagagtccggggaggaggcaaggcatgtgaggggaaccctgatgagaaccggccggctgatgcataccgaaaaatgtgagcgtgcaggaatgaacccggagaaggaggggagcagtggactatagaaaataccgggcaggttttgtggagaaactggcttgtgcggcagtgggagcaggagcggcaggaatggcagcgtggctgttttaccggtctgtgtggggaatgctgctgtttccggcagcgtacctggtatgcgtgaaaaagtattgcactctgcaaaaggaaaagagaaaggaacagctgctcatggagttcaaggatgccatgcagtctgcatcggcggcgctgctggcaggatattctgtagaaaatgcatggagggagacggagaaagaacttctggaattgcatggggagaagggatttatggcggcagaggtgcgctggatgaatgagggggtgcgcatgaacgaaccattggagcgactgttgctttcgtttgcggcgcgaagcgggtgtgaggagatcgagagttttgcggaggtgttcgcgtttgcaaagcggagcggcggagactttgtccacattatgcagacgacggtacaaaaactcgcggggcggattgaagtcgaaagggaagtggcaaccgtgcttgcaggaaagcgtctggaggggcggattatggaaataatgccgcttgcaattctggcatatcttcaggtggcatcgggagaatttctggacgctttgtatggcagcgcattcggagtggctgtcatgagcatcgctttttgctgctatcttgccgccatcaaatggtcagagcatatattgaatattcagatctgacgaaaggtttgtggataaagagggggaaaatgtgattgtatgtggaatagcgcttggactggcggtgctcggatgggcagtcagccggaaatggggcaggaaagactggcagaaaggggcggcagtcattgcggcagcggcatgtctcgggctgctgtccggatacatggaactgcagacagatgaggatccggagaaggggctgcttcggagagaaaatggagaaggtgactacgaggcagacctgcgtatgtatgtggatggggcgaaaaaggccaaagcttacaaggtgcatgtgccggagcaggagctgacaaagcaggaggagcaggcatatcttcgagcggcagaggaagaactcattaaggaattcccgggagacaatgaatctgtgaattgtatacgggatgctgttgtcattcgtgaggaatatcaggaagggcatgttgaggcggaatggagctttgacaattaccggctgatagagagccgcactggaagaattgtgggagaaccggacgaggagggggagctggtgaatgtgcaggtcactctgacatgtggaaaatccagatgtgtacaggagttttatatctgcgtgtatcccagactgttagacgaggaagagcgcttccggaaggggatttcagaaaagattgcgcgacagcagtcggaggcgggagcagacagactttttctgccggatgaggtggagggacataccatacactgggagcaaaggcgcgatcagagaccggaaaagatccttatactgggcgtgattctcgcctgctttgtaccggtggtatccatgagcagaaagcaggaggagcaaaagaagcgcaaaatgcttctggaactcgagtatccggatctggtgagcaagctggccttgcttctgggggcgggaatgacgcttcagggagcgttcagaaaaattgccggagcttatggacagaagcggacacagaataaaacggcggaaatgcccgcctatgaggagatgctggtcgcctgccgacagatggagagcggtgtgggggaacagcgggcgtatgagcatttcggagaacggtgcggtgtggcatcctaccggaagcttgccggcatactgacgcagaatctgcaaaaaggaacccgcggtattacggtactgttggagcaggaagcgcagaatgcgtttgaggagcggaagcatgccgcaaaacgttacggtgaggaagccggaacaaaattgctgtttccgatgatgctgatgctcggaattgtgatggtgatactgttggtgccggcggtgctggcatttcaaatttagaaagggagggattctatgagagggatcagagagtttatcagagaagaagacggtgtgggagttgtggaattgattctgattctggtcgtgttgatcgggctggtactgatctttaaagatcaacttacaagtctggtgaacgatattttcgatacgatcacgaaaaaggcgggaaaggtctgagaatgagaaagagagcaagtattacggtattttccgcacttgcgtttgcgctggtggcatccttccttatggctcttctggaggcggggagggtgtaccagatacagacgtatgcagatatgaagtccacgcttgcgctggagtcggtatgcgcagagtatcagccggtgctctgggaagaatttcatctgctgggactggatggcgcctacggtggggatatattttccatggatcatgtaaccgctgttttaagagagcggcttgaccggaatctggacgttgatggagcgggaggaagcatcctgcaggtcacccttgcaggagcagagccggtggcataccgtctgatgacggatcaggagggaagcgtgtttctgcactgtgtggcagcatatatgaagcagaatatggcgatggagaccatacgggcattacaggaacgctatggcgagcatgagcaggtggaacagagcggacagggggaagagagtatcgaggatgccagaacagcgatcgaagaggcaaaaagcgaacgccgggaacaggcagaatcggacgggacggaagcggtgataccggaacttccgccggagcaggaaaatccgctagaggttgttcatgcgataaagcagaacgcactgcttggaatgacgctgggggattttggtgcggtctcgacgaggcagaccgatctgggtgattcgatagagaggcggcagaaacagaccggcaatatggaaatacaggtgtcggactggtatgacagaatactcgcactggaatatatggatcaatattttggagattatctgggagaatcagaggatcacgcgctggcatatgaactggaatatgtgctggcaggaaaaggatcggataaagagaatctggaaagcgtcatcaagcgcctgctgtttgtccgggaggcagccaatatcacgcatatcctcggagatggggacaagcgggcaaagacgcttggaatggcggaggcgctggcgggatttacgggaaatcctgcggttgtgcggcttgtccagacgggggtaatcgcggcgtgggcgtatgtggagagtattttggacatccgggcattgctggcgggggataagattgccttgataaaaactgagacgcagtggacagcgcagtttggcagtcttgcggcggcgtttgaagacggcaaaaaggcaaaaaactgcgaaaacggtgtgagttatcagggctacctgaagggattcctgtatacagtgtcatcagagcggctggcgtaccggatgatggacatcatggaacggacagtacgcctgcatccaatgtatgcagactgccgcatggatcatgtgctgtgtggcataagttaccgcatggattatgagtggcagccgttgttttccgggctgatggtacatacagggagagatctgtccggtctatgctatcagacacagcgaacgttttcgtatgattgaggagggaggtgttgcggtgtctctttatgaggtagaagcaaggcgaatcataaaaataataagaaaggacaaatctctccccgaacaaaattccatatctggttcagaaaatatcgcgcgaaaagggacaccgcaatgcctccgtctgtctgcagtatttacactggaggcagcagtcgtgatgccggtgctggcatgcttttttgtgagtgttctctttttcttccgcatcatgcagattcagcttgaggtgcagagggcattggatgatacgggacggaagctggcagtctgcgcgacaactgtgtcatccgacggggcggcgctccctggaatggcagaggctttgcttttgagagagatggcggaccgcacggaagcagaaacttacatcacaggaggaaagtttggaatcagcctgattggatccgatttctccggggaggagatcacactgcgggcggcgtatcatatccggctgcccatccggatcttctggttgtgggattttgcgatggaacagcgggcagattgcaggaaatggacaggatggagtgctgcagagggaagtgatgaagaccagtgggtgtatgtcacacagacaggaaccgcctatcacagggagtatagctgcacgcatctggagctgtcgatccggtctgtggcggaggcggaaattgcggcacttcgcaatgagaacggggaagcatatagaaaatgcatgcagtgccggtatgcggaaaatgcattcggacggctctatattacgaaccagggcgactgctaccacaaagatcttggctgcagcggcatcaagcgaaccgtccgcatgatacggctgtccgaggtgggaacacgcagaccgtgcagccggtgcgggcagtagcgggagagagatggatgagaggagaagaaagacaatgcagaattgtgtgggtgaggtgttgctgcttggaatatttgcggtcacggcataccgcgactggaaggaacagatgatatgcgtgtatgtgcctcttgcggcgggaattgcaggactggttcttcacctgatgctcccgacacagaagctgacggatctgctgttgggtgcaggaatcggcgcggtgcttttgcttgcggcttgggtcagcagggaggagattggctacggggatggcgcaatgctgatggcaagcggtatttttctgggattctggcggaatgtggagttgtttttaacggcgcttatgttgattgttccggcggcgttgtttggactcattgtgaagcatagaagaaaggattaccggatgccgtttcttccattcctttttgcggcgtatgtatttcagctgggatggcggtagaaaacgggacgaaatggagaatttatgaacggatggagaggaagtctgaccatagaggcggcgcttgtggtgccgctcgtgctggcgttgtttgcattcgccatgaagagcggtattcagatgtatacagagtgcagggacaccgcgctggcgatagggcaggagcaggaaatagaggcggtaaagatgttttaccgctggcaggaagcgggggaattatttcaaaatgaagatacagtatattagaaaactgacggcaagctacatggtgctcgcgcagtgtgaagaattgcaggaatgggaaaaaaagatgattgctcatgctccgaaggggaatattgtgtttgcggaatgtgtgcaggagaacggagaaaagtatctgtggtataacattacaggaaaacaggcgctggatgcggtgttggagacggagacgttttcctatgatatgttgtgcaatgtactcaacggaatttatgaggcagtgcagcagttagagggaatgctgctgccggcacagagtattctgttgtcggcggaaagtattttcgtagattaccggaccagacagatttctttctgctactatccggggaatccaatgccgctgccggaagccttccggacgttcatggaatatctgctgacacgactggatcattcggatgagcgtgcggtcaaagcggcatatgatatttacggacagagcagtgcagggggaatggagttaaaggagctgaaatcgctgcttttaatgccgtatgaaaaggatgaagcgaagacagagccggagggtctggatgacacagaaccggaagagccgaaagcatatgccactgtcggacagaaggaacaggacgggaagcgggatgcttccatatggaagcagatttttcgcggagagagcacggtgcaggaactgcttgcggcagtgtgggagaaaatatggaaaacgacaggcacagctgcaggcagaccggcaggtgaaaaggcaggcagaccggcggacgaagcggcagcatccggggacaaaagaagaacgggcagatggaagatcggcgggaatatgaaaaatatgcagaaggagccggaggcgtttgtctttgaaccggaggaagaggaacataaatccgcaaatcccacggtgcttttggcgggaatttcgcagaaaccggaaggaatcctgcgctacgaaggaaccggcggatactcggatctggtgatagagaaagacaactatgtaatcgggagtacagcggagtgtgatggccggattccgagtgcgaccgtgagcaggaggcatgcaaagatcagcaaaaagggagctgtcttttttatagaggatctcaattcgtcgaacggcaccagagtgggtggagaattgctgaattataaaacaggaatgagtctgcagaaaaatgaggtcgtgatgtttgcagatgaaaagtttagatttatttaagaaaaaatgagggaagtacgtttgcaatctgcgcccggtctaactataataaccatattataagagtgcagacagaggtaacgcgtatggaaaatgcagcagtcgcaaatgtattaagaggagaaggctaccgctattgtcacaccaatctggcggaagccggaatttattataagtattatcaggaggggttccatattgtaatggcggtagatctctccggcggaaaccggttctctgtgcagcagtaccggagcatggaagaacacgccatggatctgttctatcacccgcaggggagacttggggatttcccggatggatttccggtatatcatgtggagatgctgacacttctgatcggcggagattccgaggtggaacgaaagttgtgcgcagagtgcaggaatgtgtgggtatatcagccccaaagcggacggctgctgatttatgagaaccagccgggagactttttcggactccggggggcattagagcagggtgccggaacaggcggcgcgggagagacgtcgcggcagggtaccggagccggtggctgggcagagacgtcgcggcagggtgccggagcatgtggctgggcagagacgtcgtggcaggacacaggtaccgcatatgcatctgcacagaatacggcaaagaaccggttgggcattttgtggaagaacatccgggcggaatatgtgaccatcgctctcgttactgtcaatgttataacatatcttgtgcttgaatggctcggagatacgacgaacggattttttatggcggagcacggcgcgatgtacccggattttatccggatcaaccatgaatggtggaggatcataagtgctggcttccttcatttcggcgcggtacatctggtgaataatatggtgattttatactgtatgggatcaagactggagcgtgtcacagggcatctgaagtattttttgatttatctggtttccctgatcggggcgggactgctctcctacgggatgatgcttcgcaccggcgattatgcagtgtcggcaggagcttcgggtgctattttcggagtgattggcggattcctgtggatcgtgatactgcaccggggcagatttgagcagattacaacccggggaattatgatgatgattgtgcttaccatctattacgggttttcctcggcgggaattgataactggggacacatcggaggtctgcttgccggatttgccgcgacagtcattttatatcacagaaaccgtcaaaaatattgattttgtgagcaaaaatttatatactgaaagcagtatgttccataaagcgacagatgggacaaaacggaggctttgaatgaaagtaaatatttattacggtggacggggactgttggacgatccgacactttatgttttgaataagatggaagaagtgctgcgcgaactgcgtgtgacggtcgatcggatcaatatctatgagcacaagaatgaaatagcgaccctgccgcagacgatgaaagaggcggacggtattattcttgcgaccacgatcgagtggctcggaatcggcggctacatgcagcagtttctcgatgcatgctggctgtacggcgataaggagaagattcagacgacctatatgcagccgatcgtgatgtctacgacctacggggagcgtgagggtgagatgacgctggcaaatgcctgggagattctcggcgggcttccgtgtccgggactctgcggatatgtggaggatctggtgtcgtttgagatgaacaaggactacacggtcatcattgagaagaaggcggagaatctctaccggacgatttctcagaagatgaaaagtctcccgaacagtaacctcgcggtcagacagagtgtgctgcgcacaccgcagatggaactcactccacaggaaagtgagcagctgtccaagtatgtatcggatgacagctatgtgaagaagcagaaggaagatattcaggaactggcatccatgttcaaggatatgcttggaaaggtcagccaggaagaggatgtagcctatatcgatcagctgcgcaatgcgtttgttccgcagcaggattttcatgccagatatctgtttatgtttgcagataagaaaaagccgctttttattgaagtgaaagatgaggatctcacgatacaatatggtcaggaagagaatattgatatctatgcaaaactgacgccggaagtaatggatggcgtgattgccgggaggatgacattccagagagcctttatgacaggcgagatgactgcgaagggcaattttaagattctgcggatgctggataccgtgttcaattttgcgtaagaggaagtgcgatggtgaaggtgcatccgtcacccggtctggaatcgcaggttaatgtaccgtggtgtgattcgatgatctgacgggtaatgacaagtcccagaccgctgcctcccgttttggaggtaataaaaggctggaagatggtatccgccagagccgggtcgagtccgccgccgtggtcagtgatggcaatgctcataaagggttcttcataaaagacgtggacatcggtagtgccactctcatgcatggcttcaaatgcatttttgataatatttatgacagcttgttttaaaagctgcggatccagttcgatcaggggaaggttctcttcaagctggaagttacagacaaagttcttccaggatagtacacggatggaagtgtcgatctgatgcataaacgaataaatgcttacctgcatcagattcagttgattgcacagccgcgcagaggacagctgaatgaccatgtttttcagaaaacagagttccgacatggattcactccagtagtcaaattcccgcacttcagggtgtttcttttcaacgagctgaagggagctgtttatcaacgtaatagaattttttatttcgtggaaaatatgaaggtaatcctcgttgcttaacaatgtaatccctgccttgttgatctgatttaacacgtgacacaacttagtgtagcatttatacaaaagaagttcaataacaaccagtttacaaaattcgacaggtgtaagaaaggagtaatcatattatgagacaagcagactgtattttttgtaagattattgcgggagagattccgtccaacacgatctatgaggatgacacatttaaggtgattctcgatgcaagcccggcgtcaaaaggacacgcgctgattcttccgaagaagcactatgcggatatctatgatatcgatgaggaagttgcaggaaaagccatgaagcttgccaagaagcttgcaggacatatgacagaggttcttggctgtgatggatttaatattcttcagaataatcacgaagttgcaggacagacagtattccacttccatatgcatctgattccacgctatcagaacgcggagaataacgacattctgatgtggagccatgagaacttctcggatgaggagatggcacagatcagagattctctgagccggaactagaaacggagcatggctttggattagaaacgatcattcaaaggaactgccacaataagcatagacctctttgggatgataagtaatattatcagaagatcacttcgtgagatttcagatggaaatgcagatggaaatttgttggagaaaaatgtcagcatttcttccagctgaatgtttgcatcggattccgtgtctcttccacgtttggacaatccgacgggtgcatgtccgacacaccggagacaatgggcggactttctggtgtccctaatggcgcctcttcacagacaatataaaaccgcgcgaaccgaaactcgttgccatctgctattaaaaatatggcagatggcaactcagacatcggcttcgcgcggttatgttttgttcagaggtgccataagggacacacacaaaagtcctacaaattgtcttccgggatgcggacatgacccgcggagtgctccaaacttggaaagacacggatcatcgaagatgcaaacatccggctggttagaaatgccacattttttgaacccaatttccatctgcattccagctgaaatccccgagtgtgtttcttataatattacttatcaacgcaaagcacaatatgcttattgcggcggggtctttctatgcaggaacctctatttgtgtgaagatgcctcgcggatcagtcccatgatcgtctcgatggagtttgtgaccttgctgtgctccatggcatcgatataagcgtcctttttgtggaagacatggtcgatggcttccaacagtgtggtgttggtcagttcttcctcctcaagaacatagctgaatccctgggaacggaaagagttggcgtttaagatctgatcgccgcggctggctgctgccgggagcggaatcaagatattcggtttgcgcagtgcgagaagctcgcagattgcgttggctccggcgcgggagatgacaagagaggagagtgcgaacaggtcggcaagttcctcgttggcatactcaaactgggcataaccggcgatggcgttcagggaagtgtctacatttcccttgccgcacaggtgaatgacattataattttttatcagctccggaagcagatcccggatggcggtattgatggcacgggagccgctgcttccgccgacgatcagaagcgccggttttgcggaatctgtaaaattgcagagtgcaaaagcgcggccggcatctccggacagtaattccgcacggatgggcgtgccggtaagcacggctttatcctcgggaacatgtgccatcgtctccgggaaattgcagcatacttttgtggcttttggaatcgcaatgcggttggcgagtcccggcgtgagatccgattcatggatgatcgcaggaatatggcagcggcttgctgcaagcacaaccggcacggagacaaagcctccctttgagaaaacgacatccggctttaactttttcaaaagacggatggattgatggtagccttttaaaactttgaacggatccgaaaaatttttcggatcaaaataacgtctgagctttccggacgagatgccgtaatacggtacaccctgctcctcgatcagccgtttttcgattccctcataggaaccgatgtaggatatttcataaccttccttctgcagagctggaaataaagcaatattcggcgttacatgccctgcagttccccctccggtcataacaattttcttcatagtaagaatccctttcctcatggtctgcttcccttatttataatacccttatgcataaaagtcaagaaaagacttggagatcggactctgcggcggcaatggaaaaagggtgtggataatgctggcacggtatgtaaaaagaatgtcgcaaattgcggtgagatcacggggaaatcctcttttcaaattcgtgcaggtttcttataatatagaagaaatcggacagggaaaagtctgatcggaaagagaggtaatggacatgctctggctggaacatatttcaccggaacagttgcagatgggagctgcggtatgcaatctgctcaccgtgatgcttctgattgtcacattacataagataaacagaatccagagatatatacagaagaaacagaccggcacggacagaaaggagagcatagagtgcggggaactttctccgacgcaatgcgattcacaatgtaaagaagcagctggtgaggtgaaaaaatacccggcggacatgctgattgatgaggttattgaagaggtattttcttaagaaaatcttcataaaaacgaaaaactggcaaaatgcacaaaaaacagccggaagtcttgtaaaatggggcttccggatgcctctttctatagaaaaacaacggcatgaagacgcggaaagccccgaaaacttgacaaaaaacagtacctttgttataattcctgctgtaacaaatccgtaacaattgtaacaaaatatgaataaaacagcacaaaggtgtaatactatttcaataaacatgtgattacaccgatggagggttctatgagtttgaagaaaagagcgattgagggaatcgtggttgccggatccctggtgatgatgagcacaatcgcacaggctgctgatcttgacggagtacaggtaaggaacgcagcggtacaggcagagacggacttcgctacagggggaacagcaggagttgttgcccggttagatcagttagaagcagaggcatttggtgatattgaagcggcgacagccggtgtgaaccagacaggaagacttctggttgctacagcggaggaagcggtttcggatacagaagctgcggagacattagatgcacagctgcagcaggccgaagcaacagagacacagcaggcagatgcagcacagagcgagacagaggcagcacagagccaggcagatggcgagcaggcagcggatgcagagcagacagacgctgatgcgcagtcggaggatgcacagagcacggacgcagatcagatgtctgcggaagagcaggagtggcagaaccgcctgatggcagatgtcgacgatttcctgtatatcagggaatccggagacgaaaatgcagcgattgtcggcaaattatacaagggagatgtggcggagatcgccgagacaggcgatacctggacacatgtggaatccggaaacgtagacggatatgtgaaaaattcctactgcgtgacgggatcggaagcatatacctatgcgaacgatacatttgatacagaggtagagatccagacgaacggacttcgcatcagaagcagcgcagacccggacgcgtccgtgctggcagcggtatcgacgggaatgacttttccgctggatgcagatgcggagaccgtagacggatgggttgcgattgattacaagggaaccaccggttatgtgagcgcagagtatgtgacgacggagcttgcactcggtgaggctgtcacgatcgaggaggagcaggcagcagctgcgaaggctgcggcagaagcggcaaagtcctcacaggtgtccagcgcgggtaccgttcagaattctgcagtgtccgcttcggtggatgatgtgacactgcttgccgcactgattcagtgcgaggcaggaaacgagtgctacgaaggacagcttgcagtcggtgcggttgtcatgaaccgtgtgagatccggcagatatgcgggcagcatttacggtgtaatatatcaggcaggacagttcccaccggcaggaagaggagccgttgcaagcattgctgcaaacggtccgaagtccagctgcattcaggcagcacaggaagcactcaacggtgctgacaatacgggcggtgcgacatgctttagcagagcttcttccggacacgcgggtgtggtaatcgggaaccacgtattttattaaacaggaatcatggcagagccgtgggaaatgatgagacatttcctacggcttttcttgtattttcaaatcaaatatagtaatatgatatttaacggggaaaattgtgttagagatccgggcagaaaagaattggaggttagataatgggaggattattagtagcatttttgattttggttattctgatattggcagttgtggtgtcctgtattaagatcgtaccacaggcgcatgcgtatattgtggagcgtctgggcggatatcttgcaacatggccggtaggtcttcatctgctgataccgtttattgaccgcgtggcgaagaaggttaccctgaaagagcaggtggttgatttcccgccgcagccggtaatcacaaaagataatgttacgatgcagattgatacggttgtttatttccagatcacagatccgaagctgtatgcatacggtgtggagaacccgctgatggcgatcgaaaacctgaccgcaacgacactgcgtaacatcatcggtgatctcgagctggatgagacactgacatccagagagacgatcaacacgcagatgagagcaacacttgatgtggcaactgatccttggggcatcaaggtaaaccgtgtagagcttaagaatatcattccgcctgcagcgatccaagatgcgatggagaagcagatgaaagcagagcgtgagcgaagagaagcgatccttcgtgcagagggtgagaagaagtctactgtcctcgtggcagaaggtaagaaagaatccgcaattctcgatgcagaggcagagaagcaggcggcgatcctccgcgcagaggcgaagaaagaggccactatccgcgaggcagaaggtcaggctgaggcaatccttaagattcagcaggcaaacgcagacggtctccgcatgatcaaggatgcggctccggatcagggtgtcatccagttaaagagccttgaggcatttgcgaaggcggcagacggcaaggcgacgaagatcatcattccgtctgagattcagggaatcgcagggctggcaaaatctgtgacagaaatagctctggagaacaaatagaacatcggatagatcagattgaaaataggggctgtcacgaaagtggcagcctgtttattctgcaacaggaagcacaaagcgacaaggaggaacgcaatcatgaacttaaaaggacgcaatttcttaaaactgatggattacacaccggaagagattctctacctgattgatctggcagcggatcttaagagcaagaagaagcagggaattctgcatgatagtctgatcggaaaaaatatagcgctgattttcgagaagacaagcacccgcacacggtgttcttttgaggtggcagcacatgatctcggaatgcatgtgacttaccttgatccatccggttcgcagatcggcaaaaaggagagcattccggacacagcgcgtgtgctgggacgcatgtttgacggtatcgagtaccgcggatacggacaggacattgtggaggagctggcaaaatatgcaggggttccagtgtggaacggtctgacgaacgagttccatccgacgcagatgcttgcagatatgctgacaatccgggaacacctgggccacttaaagggtgtgaagtttgtatacatgggtgacgcccgctacaatatgggcaattccctgatggtgacctgcgcaaagctcggtatggattttgtcgcatgtacttccaggaaatatttcccgaacgaggagctggttgattactgcaaaaaagtagcagccgagaccggagcatcgatcacgctgaccgaagatgtggcagagggcacgaaggacgcggacgttatttacacggatgtctgggtatcgatgggcgagccggacgaagtctgggcagagcgcctacaggatctgatgccgtatcaggtcaacaaggcagccatggcaaatgccaagccgacggcgatcttcatgcactgcctgccggcattccatgacttaaagaccaagatcggcaaggaagtctatgagaaattcggttacagcgagcttgaggtgaccgacgaagtatttgagagtgagcagtcggttgtatttgatgaggcagagaaccgtatgcacacgattaaggcagtcatgcttgctacactgggagaataagagggaacatcatgaaagcagaactactttccgttttaagagatgccgacgattatgtgtcaggacaggatctgtgtgaaaagttcggagtatcccggacggcggtctggaagggcatcaaccagctcaaggaagccgggtatgagatagaggcggtgccgaacaagggatataagctgttgtcggtgccggacacactgagtgaggaagaattaaaaagtatccgtaagaccgcgtgggtgggacaggagattttttactatccggtcatcgattccaccaataccagggcgaagcagctggcggaggaagattaccctaccggaacgcttgtggtcgccggacagcaggatgcaggcagaggcagaagaggaaggagctttgagtccccgcagggagccggcatttttatgacgctgatgttaaagccggagttgtcgcccgtgaatgcgccgatgttgacgctggtggcggcgcttgcggtgtgtgcggcgatcgtgaagacgacaggcagaccggcgggcatcaaatggccgaatgacattgtcatgaacgggaaaaaagtctgcggtattctgacggagatgagcgcacagatggattatgtcaaccacattgtgatcggcattggcatcaacgttcacaatgaatcgttcccggaggagattgccccggtggcaacttcactctacatggagaccggagaacattttaaccgcgcggctctgattgaggaagtatgggaacagtttgaacattattatgcaattttcatggagaccgaagatctgagcggtcttgtgaaggagtacgatgcgcatctggtcaaccggaaccagatcgtgaaggtgcttgatccgaaggaaccgtttgagggaaaagcgatgggcatcacgccgcggggcgagctgatcgtggatacctgggagagcagaagactcgtatcggcgggggaggtctccgtccggggcgtctatggatacgtgtagagggtgctgcgcgggcggcgtccgtggaaacggtttggaaaggaatgtctgagatggaagaagtggtactgtgcggtgcgagcgcatacaataaaaaattttacctgaacgaagattttaagggtctgccggagcagatcaagaacgagttgaagatcatgtgcgtgcttttcacggaggatgtgggcggtatttttcagctggtgttcagcgaaacgggcgaactggaattccgcacctcctgcgatgaaaatgatctgctgtacgacgagatcggctgcggacttaagatccgtcagttacagcagacaaaacaggaactgctggaagcgctgcagatgtattataaggttttatacgtgggaatatagggggtacggacgatgataatgacgattgatgtgggaaacacaaatattaccgtgggagtattccggggagacgaggtggtatcgaattttcgtatcacgacgaaaatgccccgtacatccgatgaatacgggatgctgttgagcaacctgctggagcagaattcgatttcacatgacgatattgaggatgcgattatcgcatcggttgttccgaatgtgatgcattcccttgagggggcgattatcaagtattttagcatccggccgattattgtggagccgggaaccaagaccggtatccgtgtcgtgactgagaacccgcgccagatcggtgcggaccgtattgtggatgcagcggcagcgtatgagctgtatggcggaccggtgcttgtccttgattttggcacggcaaccacgtacgatctggtggacaaggacggcgcgtttgtatccggcgttacagctccaggaatccgcatttccgcaaaagcattgtgggaagatgcggcgaagcttccggagattgagatccgcaagccggcgagcatcctcgcgaaggagacgatttcctccatgcaggcagggcttgtctacgggcagatcggacagacggaatacatcatccgtcatatgatcgatgaggcgaacatgggcgaggtcaaggtcgtggcaaccggcggactgggcagaatcattgcaaatgagaccacaatgatcgatgtgtatgacccgaacctgacattgaagggcatgaatctcatctataaaaagcagaaccgtaaatccgggaagattaagtaagtagaaaatgagggtggcagcgtggcaataatccgaacactgcagataggaaatgtaaccttagaaaataatttgatactggcaccaatggcaggcgtaagcgacctgccatttcgcttgctttgcagggaacagggcgcggggctggtgtgcatggaaatggtgagcgccaaggcgattctgtataagaaccgcaacacggaggagcttcttaccattgatccaaaggagcacccggtatcgctgcagcttttcggctccgatccggatattatcagtgagattgcgaagcagattgaggagcggccgtttgacattctggatctgaatatgggttgtccggttccgaaggtcgtcaacaacggggacggctccgcgctcatgaaaaatccgaggcttgccggggagatcatagagaagacggcgcgggcgatcaaaaaaccgctgaccgtgaagatccgcaagggattcgacgatgcgcacgtcaatgcggtcgagctggcgcacattgcgcaggagagcggtgcggcggcggtcgcggtgcacgggcgcaccagagagcagtattatgccggacatgcggactgggatattatccgccaggtgaaggaggcggtatctattcctgtcattggaaatggggatatccgcacaccggaggatgtggcggcgatggcagagcagaccggctgcgacggctatatgatcgcgcgcggagcggagggaaatccctggattttccgtcagattctgcattattttgagacgggggagcacctttcccggccggatttttcagaggtgacggagatgctgctgcgccatgcaaagatgcagatcgactgcaagggagactacacgggcatccgtgagatccgcaagcatgcggcatggtacaccgcggggtaccgcaattcgtccaagcttcgaggaagaatcaacgaggtggagaattacgagcagctcgaggcattattccgggaagtggagtcatataatgagaaaaacggatacgaggcataggaaatgtcctattctaatgagtttcttagaaatttccgaccggtatttctggcgatcttaaaggcgcaaagctttcgcccggagcgcgtggagcttgtggtgattgacgaggagcggagccatgtctttgaaccggcggatgtgcgcgatgtgctcgaacagatcggtgacgatctgaattaccttacggtgtacaccgggcgccccgcatatttttccgcgtttgcagagagaatgtatgaggagaacgggctggtggtgatggtttttcccaaaaccagactgtctgcgtgggaaggacaggcgggggtgagagaaacgtttctgacccggaaggtaatcctggattttgagtgggagggagcataccggacagagatgatctgcgccgcggcgacctacatcccgatccacaaaaagccctggaaacaaggcgaaaatcttgacatcatggtgcctatcggttataatactgtgattgttaagagcatgcatcaccagagagaaaagcttggacgtgaccgatttgaagaagctttttatgaaaattgaactgataaaaattacaaagaagggtagagagtaatggacaagaaaaacattctgacgtatgaaggactcaaaaaactggaggacgaattagaggatttaaaggttgtcaagagaaaggaagtctcccagaagatcaaggaagcaagagagcagggcgatctgtccgagaatgcagagtacgatgcagcgaaggacgagcagagagatattgaggcacgtattgaagagcttgagaagatcctcaagaatgctgaagtatttgtagaggaagaggctgacttagataaggtaagcatcggatgtcaggtaaagatcttagactgtgaattcgacgaggagctgacctacaagatcgtgggttccacagaggcaaacagcttaaagggcaagatttccaatgagtcgccggttggtaaggcgcttcttggaaagaaagtcggcgataccgtaacggtaacgacaccggcaggagagttcgagtacaagatactttccattcacagatcatcaaacgagtagagcatgaccgtctgcggactccgcttcatgcggacaggcggcgcaggataaatggaggaaaagcatggcagagcagaataataaccagcagcaggacgtcaaccagctgctcaaggttcgttatgataagttacacgaactgcaggagaacggaaaggacccgttcgtcattaccaagtatgacgtgacgaatcacagcacggatgtcaaggagcattttgaggagatggaaggcaaggaggtatctcttgccggacgtatgatgttcaaacgtgtcatgggtaaggcatctttctgcaatattcaggacttaaagggacgtatccagatctatgtagcgcgcgacagcatcggcgaggagtcctacgcggatttcaaaaagtatgatgtcggcgatattttaggcgtgaagggtatcgtttttaagacgaaaacaggcgagatttccattcatgcagcagaggtaacactgctttccaagagcttacagattctgccggagaagttccacggactgacggataccgataccagatatcgtcagagatatgtcgatctcatcatgaatgaggatgtgaaggacacatttgtgaagcgttccaaggttatcagcacgatccgacgctatctggacggacagggcttcatggaggttgagaccccgatgctcgtgtcgaatgcgggcggtgcggctgcaagaccgtttgagacacatttcaatgcgttagacgaggacttaaagcttcgtatttctctggagctttacttaaagagactgattgtcggcggcatggagcgtgtctatgagattggtcgcgtattccgtaatgagggtctggacaccagacacaatccggagttcacactcatggagctgtatcaggcatataccgattaccacggcatgatggatctgaccgagaacctttaccgctatgtggcaaaggaagtgaccggttccgagatgctgacctacggggagcataccatggatctctccaagccgtttgagcgcattaccatggtggatgcggtgaagaagtatgcaggcgtcgattttaacgaggtgaaggataccgccgaggcgaagaagcttgcagatgagcatcacatcgagtacgaggagcgtcacgaaaagggcgatatcttaaatcttttcttcgaggagtatgtcgaggagcacctgatccagccgacgttcgtgatggatcatccgatcgagatttctccgctcacgaagaagaagccggagaacccggactatgtagagcgttttgagttcttcatgaacggctgggagatggcaaatgcttactctgagctgaatgatccgattgaccagcgcgcgcgttttgctgcccaggaggaggcttttgcagccggagatgaggaagcgaaccacaccgatgaggatttcttgaatgcactttccatcggtatgccgccgaccggaggtatcggattcggaatcgaccgtatggtcatgatgatgaccaacagcccggcgatccgcgatgtactgctgttcccgacaatgaagtccttagacgctaagaagggcgaagggaaggctgaaaaggcagtagaaaatgctgctgtggcagaggaaaaggttgcagaaaagattgatttctccaacgtaaaaatcgaaccattgtttgaagaaatgattgatttcgatacctttgcaaaggctgatttccgtgcagtaaagattctggaatgtgaagcagtaccgaagtcaaagaagcttttaaagttcactctggatgacggaacagaccggaaacgcacgattttaagcggtattcacgagtattacgagccagaagatctgattggcaagacagcgattgcaatcgtaaatttgcctccgagaaagatgatgggcattgattccgagggtatgctgatttcagcagtacacgaggaagatggacatgagggattaaatcttctcatggtgaatgaccggattccggcaggtgcgaagttgtactaagaatcagaaaatccatagacttttatgagtttatcgagtgtttgacatcaaattgacatcaaatttgtgtcattcggtggactaatatggactgaaaagggatgttttagaaatcagaacctttcaaaacttaatagttgaatgctattaaaaggacattttccaataaaacggagagtgtcctttttctgttgttatggtcaaaacaaaatcaaaataacacaaggagggttctattatgacaagtacagcgttaggagcagaaaccaaaaaggaagaaaagattatttttatcagcgatgcacatgagaaattctactacgagaagttaaaggaagtccggtatcaggatgtttaccacaaggcactctgctattgtcttgggatcagcgatgataccagaagaaatgtttacagaatttatgatttcaaaacaggatgcgtaataacagagtgtttacacgaaggctggcagaccagtggaagtgtgagagtgatcagaatggcattcaatctgtattgcaatggaacaccaagtgtttccgattatgaagatgcagaagaacaggtggacgagtgcaggcagtacacggtggaggaaatattctgctgtgcttatgcaccatatttctggcaggcaattcagattcggtatccggaatatgccacatacaaccataagctgtatgccttattgggaggaacagactaatgttaaaagtcagattgatgggaacaaagaatgatattaagtggttcggaaagattttgcagaggaatccgaaagtggaagtaacggagttttccgagatgtatccgaataagggaacgaagaaattttacagggcgtatgtagaagtaaagaaaagaaacgtagcagaaaaatagcagaaaacaaaggagaatctatcatgtgtaaaataatcgcaatcgcaaaccaaaaaggtggtgtgggcaagaccaccacaaccagtaatttaggcataggattggcaaaacagggcaagaaagtcctgctgattgatgccgatgcacagggcagtctgacagacagtcttggcttcacagagccggacaagctagaggaaacacttgcaacagcacttggcaatatcatcaatgatgaagatatggaagcggattatggtatcctgaaacacaaagagggaattgacctgatgccgggaaacattgagctttccggtctggaagtatcacttgtaaatgtgatgagcagagagcttgtgatgcgttcctacatagagctggtaaaggataattatgattatattctgattgactgtatgccctctctcggcatgattactataaacgcttttgcctgtgcggacagtattctgattccagtgcaggcggcatatcttccggcaaaagggttgcagcagcttattaagaccataggaaaggtcaggagacagattaacccgaagctgatgattgaggggattctgctgacaatggtggatgctcgaaccaattatgcaaaggacattactgcattactggtggagaattacggtagcaaggtgcggatatttgaaaacagtattcccatttccgtccgtgcggcagagatttccgcagagggtgtcagtatctacgaacatgatccgaaaggcaaagtagccgctgcttatcagtctttgacggaggaggtgcttgggaatgagtaaagcaggaagtgccgcaaaggtaaaattaagcagttatgatgatttatttggaaatgcagaagaaaagacagggagcgaagagcagattatcagagccaagctcacggatttgcatgagtttagaaatcatccgttccgtgtactggacgatgaaaaaatggaagaaacaacggaaagcatcagtaagtatggggtgctcgtaccgggaattgcaagaccgagggcagagggtggctatgaaatcatagccggacaccgcagaaaacgaggttcagaacgggcaggaaaagaggatatgcctgtgatagtccgcaattatacagacgatgaagctacgattatcatggtggattccaacattcagcgtgaggacattctgccaagtgagaaggcgaaagcttatgccatgaaatacgaggctatgaagcatcagggcagaaaaggaaacggaaatacgcttgacgaggtaggagaagctgtcggagaaagcggaaagacggtgcaacggtatatctggcttgcaaggctgtccgatgagctgctagagttggttgacagaaagaaaatcggtctggtacagggtgttgacatttcctttctgtcggaagatgcacaacagtgggtgctggtaatccttgaggaaagcggagcaaatatttccacagtacagtctgccaagctgaaggaatatgggaaaagcggcgaactgacgctgccgatggtgcgtctgatactgaccgaggaaaagccgaaagagaggaaagttacaatcaagtctgaaaaaatcagccagtttttttcagaggaatactccagcgaagagattgaggggattatcctgcaattattggaggaatggcagaagaaacagtaaagggggtgcggtaaaatgggtaaacagatacagtttgattattactatgggattgaagcagaacagttttccttttatcgtgttcctcggttgctgattaaagacgagcgtttcaaggggcttagcagcgatgccaagctcctgtacggtctgatgcttgaccgtatgtcactgtctatgaaaaatggctggttggatgaagaaaacagagcctatatcatttatactcttgataatgtcatggaggatttgggatgtgcaaaagcaacctgtgttaagattatgaaagagttggacagtgataatgggataggattgatcgaaaagaaacgcaggggacttggaaaaccggatattatttatgtaaagaattttgccacaataggagaagcagaagaagaaacgcctgcaaatgctgatgtttccacagaagttcaggatttgaacctcaagagttctaaaagttatacttccagaagttcagaaactgaacttcaagaggttcaaaaagcagacttccagaagtctaaaaattttacttcaagaagtacaatatctgaacttgcggaagttcaaaaagcagaccctaattatactaactataatcatactaaccagagtaatattgataggaattatatcaatcctatcaatcaatccggcagtgagttggaaggggagattgatgtgatggaagatgtcaatgcttacatggaaatcatcaaagagaatattgagtacgaacatcacatgaaatatggcagatggcaggacaaagggctgtatgaggaattgtatgaggtaatctgcgagattgtatgtgtgaagcataagactgttaaaatcggtggaaatgattatccatatgagcttgtaaaatcaaagttcctcaaactgaatagctcccatttggaatatgtgataggatgtatgcaggaaacaactacgaaaattgcaaatatcaaggcatatatggtaacagctctttataatgcaccctcaacgatgaatcattattatcagcaggaggtacagcatgatatgtacggaggtggctggaatgaaaagaatattggttaaaattgtgcttccggtatcgttgctggcagtttggatgataacctgttatccgatttgcagaaaagcagaaggatttgattttttcctgtattgggtactggtcggctgtccttatgggatcagaaaaatgtgtatgattctcataccaaaaaatttcggaattgcaggaagtataggaatactggcactgaactgtattgtaggtggtctgattggcagtgtggttgtaattctgagaatggttatggtgctgatggagataataaagataatcagtgatacttctggacacgatgtccaaaggtgcagatgaaaagcgaaaatgaaaaaggcattgttcatcaatcagaacaacacctttaattatcatccgggacgtattccataatctcttcaatccggcagttaagtatctggcaaagcctgtttaaaataagcgtttttacaacaaggttctgccgaagccgctgaagctgtgctttatcaatgccataatctttgataagctggtactggctgattcctttttcctttagcgtacgccaaagcggatcgtatttaatcatactgaaagctcctttccacacttgtattctaagtgcatgaaacatataataatatggtgcgtgtacgcaccataaaacatacaaggagagtaaaaaagttatggaacataatgagtttaaggatcagctatacgaagtattagatgaaaatgatgtggctttagggattgaggatatagatacctctgatgccgcaaatatttttacaataaaaacaagggacggaagtgtttttgaaatagaaacacggaagattgaataagaggcagcacgatgcctcgaaacaggaggtttgcaactgtggagaaaagttacattacagacatagaacgggaacggtgcaaaaaggttgccgcagcctatgcagaactgtatgagctggaaagcattttggtattggatgtaggacggtacggttttgtgaagctgcaatattacacaccggagtatggatttaatgatgttataacctatacagacagtgagagtatgtttgaggacttatggcaggaatggcttgatacccggctctatctcttcgcaaagggaacgccgatgctggaaatgggatatgaggaaatcttcaaatgtctgccggaggaaaaacagaaagagcttttagagcaaaaagcagtatttgcaaaaatggcagaaatagaactgaaataaaacagcgtcagggcagttatgaattgaaagatttgtagctgcccttttttttttgcttttggacacgatgtccagaagcggaaaggagcaaaatggaatcattacgagatgtaaaaagagttatggaacgggagatagagaaagggagctgcccattacagtttgaatatctggaatttggagaaaaaccgtttcagttcatagaatcagaggaaaagctgaatgaggtgctttcgtatttgttgcggttgggggaatatcgaggatatacggagcatcttgtaggaaataacgtgtatatggatttggatatgttgtgccggaaaattcagtttaagcgtacccattcccctgtggagcgtagtgaaatccagtggaaaatacaacgctataaaaataaactgaaaccggactatgcaggtaaggtttgtttagaaatagtgcagtgcgttttcagtctgccggaaggagcagcggagaaggaccagattgtatatgatggacagaaaacctatgcttttgccatgtcaaataagtatattctgggactttttactcattgtgaagccgcaagaaaatctgctgtggaggacggtgtggagtttgtacatctgccggagaatgaacagaaaatcgtcagtcttgaaaatgtgaggaatgtgttgtttcaggcattgctgcttgataatgttacggtggagaatggtctgttccatgcacagatgtgtacggttatgctgttgaaataaatgtaccggaaatatttgatacaggcataaattttgttataatggctttgaacagaatttgtccgaaagagggattgtatgaaaccaaatcatcattcactggcatataaacagcagaaacagccgaataagacctataaggatttaaaacagaagcagaagatgaaaatagcagactggatgtttcgggaaacctgcattttctataaggaaaatggagagataccaaatgaggaggtagcaaagcagattattgaccggatttatgaaaaactgaaatctcttgcaatctgggttccgtatgaagaggtttaccgagcatatcttttaaaattgccacgatatgagcttcgtattgcggaaaatgggataccggaagaaaagccgccgaaggagaaaaaggaggatgtgccgaaaaagaaaaagggaagcagtaataagcggtgtccggtatgcggcaggagaatgaaacagcagtttattggtttgcagcattgcaaatgtggaatgagctggaaaaaggacatcggcttttttgagcgaaccggagatatggtgtttgccttggagcggagaaaaataggaaataaacaaaaacagtgccctgtcattcgatataaggaatagggcatggaaaaacagaaaacagcgtcagggcagttatgagtcgaaagatttgtagctgcccttttttattgcttttggacacgatgtccagaagccggatggaggtcagatgaaatgaaaaagagagaatttcagaaaaaagcagccgcagcgttattgggaaaactggcagatgttgtgatggaactggaagaaaatccaaacatcacaataacgtcggagtatcatagtagctattttaaattgagaaagaattacaatctgattcagatttcggtcaagcagacaggagagctgacgtatcagttgacggatatgctgggaaacacaggcagaagtcagatttatgtacaatatcatgctggagatgatccggaacatttgataaagaagtttgttgaggattttgggcggctttataaggattttcttttagcgggaacgctgcatgattttgttcgtatccagttatctgtggatgcagatacagaggaagcattaagggagtacgaggactgtatcagagcaggctgcctgtaaatcagaatttttggacacgatgtccagaagcggaaaggagagaacatgaaatatttactacatcggctgcttgttccgccctgaaggaacagcagtaaaaaggaaagaaggaggtacagatgcaggaagaagtaacgcagaaaacaatcgcccttgtgattaaggctgcaaagctggatgccaatatcctgaaatctgccatgagaatgtatctgaatcattgcagaaaacaggcacagaaaacgcatgggaaagtgtcggttaaggaactggtgggcgagggtgcaggtgcttcatccattgaaatcacagatggcaatatcaaatcctttgagcgggtagctcgtaaatacaatgttgattttgctgtgaaaaaggataagaccaccgagccaccgaagtatctggtatttttcaagggcagggatgccgatgctgtggcacaggcatttaaggaatttgtttatggaaatgagaaaaagaacagtaggacttctgtaaggcagaaattaaagcatttccgggatgtggtatcaaaggatcagaacaaagaacggagccgggaaaagaataaggacagggggcagagcctatgactaatatcatagcaggcattaccaaagatttaaaagctgtccccaaaaagctgaaggaaaaagcaaaaagtgcagatgttaaaaagctgatactgctgaatcttccctatgtgcttgccgggtacttctgtaataaggcagcatttttatggagagtggcagagggcagtaatgcgtctgacaagatgatggtagtaatgagccaaatggacaggatgttttccaatccgttccccagtttttttctgagtgatttgctgattggaatcgccggaggcgttgccttaaaattcattgtttattataaggcgaagaatgccaagaaattccggcagggtgtggaatacggttctgcacggtgggggaatgccaaagatatagagccatatatggattctgtatttgaaaataatattcttctgaccgctacggagcgtctgatgatgtccggcagaccgaaagaaccgaagtatgcaagaaataaaaatattcttgtgattggcggttccggctccggtaaaacaagatttttcgtgaagccgaacctgatgcagatgcactcgtcctattgcgtcactgacccgaaaggcacaatcttagtggaatgtgggaagatgctgaagcggggcaagtataagattaaagtcctcaacaccataaactttgcaaaatccatgcattataatccatttgcttatctgcggagcgaaaaggacattttgaaactcgtcaacacaatcatagtcaacacaaaaggagaggggcagcaatccggtgaggacttttgggtcaaagcagaaaaactctattatacagcattgattgcatacatctggtacgaagcaccggaggaagaacagaattttgccatgctgattgatatgattgatgcaagtgaagcaagagaggacgatgaaaacttcaaaaatgctgttgatctgctctttgaggagctggaggaaaaagacccgaaccattttgctgtaaggcagtataagaaatataagcttgcggcaggtgatatatgctctaagtgacttcttaatcatgattttgtcatggttagtgaagcaatcacttagagcatttttgtttcaggaggtacagccatgagaaatgaaaaaattaccccactgtacgagcgcctgagccgggacgatgagttacagggcgagagcaactccatatccaaccaaaaacagatgttagaggattttgcccgccggaatgggctgcccaaccctacgcactttaccgatgatggtatctcaggcacccggtttgaccgccccggatttttggcgatgatggaggaagtggaggcagggcgtgtagaggcaatcgtcatcaaggacatgagccggttggggcgtgactatctgaaggtcggtcaggttatggaggttttgcggcagcgaggcattcgtctaattgccatcaacgacggtgtggacagtctgaaaggcgatgacgattttaccccgttccgcaacattatgaatgaattttacgcccgtgataccagccggaaaatccgctctgtgtttaagtccaaaggcatgagtggcaagcacctgaccggcactgtgatttacggctacttatgggacgaaaaacgggagcattggctggtagatgaggaagccgccgaagtggtacgccgtatattctccctcacgctggagggatatgggccttaccagatcgcctgcaaattatccacagaccggattgaaattcctgtcgtacaccttgcccgcttcaacgagggtgtgaatcgttcaaagccggtcaaagacccctatggatggggatcatctaccatcgtgaacattttgaaaaaacgagagtatttagggcataccatcaatttcaagacccgcaaacactttaaggacaagaaaagccactatgtttctgaggacgaatggacgatctttgagaatacccatgaagccattatcgacaagcagacctttgatttgacgcagaaaatccgcagcaatgtacggcgttatccaaacggctggggcgaagcggctcccctcacaggcttgctctattgtgccgattgtggcggcaagatgtatgtccaccgtaccaacaatggcaggcggatttctcaatatacctgttccaattataccaaagttccgtgtgggacactatgccctacacaacaccgtatcaatgagagtgctgttctgacattggtttctgatacgctccgggctatcgctgaatattccagaaatgaccggacggaatttattcacaccgttcaggaaacgcaggttgctcaacagagtgccgatatatcgaaaaagcgcaggcgtctggctgctgctcaaaagagagccggagaactggaaaaactgatttgcaaaatctatgaggacaatgccctcggcaagctgccggatgcacgatatagggcgcttgatgcacagtatgccaaagagcaggacgcacttgagattgaaattgcggagctggaaaaggctgttaccggctatgagcagagccagaaatccgcagagaaatttatagccctgattgataagtatgagaattttgacactctgacaaacaccatgctcaacgagtttgtagagaaaatccttgtccacgaacgcgcccgaaaaggcagccaggacaccacgcaggaaattgaaatctacttcaattttttagggcgctatatcccaccatccttacagccggttcctttaacaccggaggagcaggaagaactgcagaaaaaagaagaacgtaaggacaggcttcatcagaattatttgaggcggaaagccagcggcgcacagaaacagtatgaggacaaaatcaaggcgaagaaaaaagcggaaatggacgctaagaaagccctgatccgggctgaggatatgaaaaaaggcgttttttctactgtcggacagctgccaaaagaagaaccacgcaaaggcagcatagcagccagcgcagcagtctaatcatcacgaagcaaaggagaatgaatatgagtaagttgacttacattcgttgtggagattatgatatacccaacctaaaactttctgaacagccggaaacttctatcggcaagtacggcagaatgcgaaaatcctacctaaaggaacatcgccccattctctacaaccatctgctgatgagcgagaagctgtatccacacctgttagagattgagcggacagcacaggagcgcgtggacaccatgttgcctcacatgatggagactgcgggtgtcacggaagaactgaaagcctgtgaccctatgcgttgggtggggctgatgaacacattaacggcacagattgaggaaattttaatcagggaactgatttgcagctgaatgggaggtgcgggaaatgctgacctttgaaaagattttgaaagtgtttcaggcatatctggatgatgatccactgtatgaggtggttcagaccagccacggttatacattgatggcatgggaaccccaccggaatgactggtacagcgcagaaatacagaaaaccccggaggatttacggaacgctttgttgggtacatacgccaactttctggaagataagattactggaaatgaccgtgacctgactgtgacagaaaccggagaaatccagcagaggtgtcgggaacttttggaaaagtgccgggaaccttgatatagaaatgccagaaggaggccgcgattatgcgtcctccttctgcttcgcagtctgttccattttgagcgccccgtctatggcaccttcgataatcggcaggtattcttcagggcaaagcttcagcttgtggctgacccgttgccgctgttcgctttcttctcgcataatctccgggttaaaataccgttccacgggaagtccgcagaccttaatcaactggatcatcacaggcaggctcggaatcgcaccttgattctcaatgttggcaagataccgccattcaatcccaaccatttctgccaatgtttttcgtgccagacgctttgcctctcgtgcagctttgacatctgcgccgaaggtttcaaaaccgggacaatcttcaactttcgccatataacatcacccagttacattgtataattcatacttcacccgtggaatgttgctatatgcaggttggttgaagtttataattcatatcccgtttcttgcattgttcgaaaaagagaactataatgtactctgtggaggtgcgaaatggactatatgacattgaaagaggccgccgaaaagtggggcgtgacacctcgtagtgcaaattattattgcgctggtgggcgtatctccggcgctgtgaatatggctggtgtttggctgatcccaaaggacgcggaaaagccgactgatagacgcagaaaggagtttcaacatgaataatgttttaattatcgaagatgataaagaaatttgcgttatgataaaagaccatctggaaaagtacaattatcaagtcttcttcacacttactggtgcaaatgcgattgaacgtataaaagaattatccccggatttaattattttagatttaatgcttccttttatcagtggagatgagttaattagaaatatcagaaaattttcagacgtacctgtaattgttgtttctgcaaaaagtttaacattcaacaaagtcgaactgctacgcttgggtgctgatgactatttaacaaagccgtttgatttggacgaattactagcgcgaattgaacgcaatttgctaagaagtcaaaaagatactcccaatctttgtttgacctttggagaactttccattaatacatcttcaaaaatagttactgttgcagacgaaattattgtgcttacagcaaaagagtatcaacttgtagaactactggcgaaatatcctgataaagttttttctaagcaaaatctttatgaaagtatttggcaagaaccatttgcaagggataatgatgtcattaacacacatataagtaacttacgaaaaaaattaaagggcgaaggctgccgaattaagaccatatggggcttgggttaccgatttgcaaagtgagctttagataatctttagctttacctttagattattcaaggaattgtctgcgatactaaataacaagaaaggagctgtgaaaatatgaacgtaacagtttttgaagctatcaacatcacaaaaaagtatcgcaatacactagccctaaatcaagtatctatgtctgtaatgcaaggagatatttatgggtttatcggagaaaacggtgccggtaaaacaacaatgattcgtttactaaccggactggcggaacctactactggcaaaattgctttattcggtgaaagcaataagaaacttgcaaagcagcgtgatcgcattggctgtattattgagagcccttctctttatcttgatatgacagcctatgaaaatttggaggtacaacgtttgcaacgcggtattccaggaaaaggttgcattgataatgctttagcattagttggtttgaaagataccggaaagaaaaaagcaaaagatttctctttgggtatgcggcagagactagctctcgcaatcgctttgcttgggaatcctgaatttctcgtactagatgaaccaattaacggactagaccctactggaattatcgaattaagaaacttactcaaaagactaaataaagaacgtggaatcactattttgatttcaagtcacattctcacggaacttcatcaattagcaaatagatatggtatcttacatgaggggaaacttttacaggaaattaccgctacagagttagacaaacgctgcaaaaagcatttgttgttgcaagtgaatgatgtagctgctgctagtgttttattggaaagcaaactgaatacttcaaattttactgttatgccagacaaaagtattcatctatatgattatgttgaaaatgccggaaaagtatcagcgttgctaagtgcaaataacattacgatttaccagttagcacaatctggagatagtcttgaaacttattacactaatttgataggagggtgccaaaatgattaaccattttaaagctgaattttataaattgcgtcactcaaagatattgataactatattaggcgtatgtgcggcggttataatggtctcttttgcacttggtgacatgactttttttggagccggagatggaacagaaagtgtaatcggatttcaagctaagtgttatctatctagtgaaataccaacgtttcaaactgttgcccgctcatctcttgcatatacagcctttttctggattattggcattttatttgcaaccatattttttacaaaagaatataatacgggtacaatcaaattatctgttgcatacggcactaaacgaactattctctactacaccaaagcgattacaatattggtggtgtctctgataacgtatctgatttttgtagctacatttttcgttattgaaatcatacaatccggttacattccaactgcgagtgaagtaataaaccttttgggatgggctcttgcttgcggaacggttttattagcattagaaagcatttctatttttttatgtgtcgttattcaaaatacagggattgtaacagggatttgctgcttatatgtattcagtggagcgtctgtttacttaatgctatggagtgatatggagacggtttcaatacccttaaaaatttttgtatatggaaatcctatgtactattggatgaatttcagctcttgtcgcacaatgggtattattgagcatttaccattctatttcatagggtgcatttctcttttgattgttggcggtcttattatgattagaaaagaaatcaagtaaaagggaggtagaatatgggttgggcgattatgtttcttgttctgatagcattggtcattatcctttcaatttctttaattaactggaaaatacagatatataaagtaatcgtccaactaaatgctattctgaatagaaaaacgaaaaagttagttacagtgtctttatctgataggcggttagagcatttggttgaaatcataaatcagattgtatcaaaagataatatttatctgggcgaaattcaaaaaaaggagaatgaattaaaagagaatatttcttgcctttctcatgatttacggacaccactaacttccattcgcggatatttgcaacttctatcaagtgcgcctgatgaaaaaagagcggaatatatttcagcattatccggaaaagcattgagattagaacgtctcatagatgacttttatcaaatctctcttttagaagcaggacaatatccattttactatgaaaaggttgagctatgctcattgcttactgaaatcctgctagacaattattcgattttcagcgttaatggaattgaaccccaaatagaaatacctaatatggacatctatcttaatgctgacagaaaggcgtgtattcgcattatacaaaatcttatattcaatgcggtaacatccactacaaataatgttgtaattcaactaattaatattgcagattctgtacaactctgtattaaaaatcctgttgcatctattcctacagaagaatattcaaaactgttggaacgcttttatgtagcagatgtttcaagaagtaatggtacgtctggacaaggactttacattgtgaaaaagctattacttatgatgaattgtacaaatccaataattgaaatacatgaccataattttatgattacgattgatttttcgcccttactcataaaaaaataatctgccggacgacggcaaaagaaaaaaagccgtcgtaaagcagatctattaacgcgcctatgctatcttccggcggctttgaaaaaacagagccgccgtttctttttgcgaaaagcagaaacccgacgacctaacaccgtgtaaatccacggcggcatataggaggattgccgccgtgtctatgcttgccttttttcacggtcccgtcaagatttatgcgcaaaattgtttgcaggctccggctgagtgaagtcagccggcaatagaggcgtcgtccatggtcgcctccaagtgcttcatgttcatgtatttcttgcagccccactgcgtccctgccacgtggcgtagcctcgcgcagaccagcatcagggcggaatttccgtcagggaacgtccccaccacgcgggtcctgcggcggatctcgcggttcagccgctcgatcacattgttggtgcggatgcgcgtccaatgctcgctgggaaagtcacaataggtcagcgtttcctcaatgccgtcctcgaccttcttggcagcctccttcagcttcatggcgcgcagctcggcaacgacggccttcgccttctcgcgggacgcctttttgctctcctgggcgtggatcgccttgagcatttttgccacaattttgaccttggatttgggcacaacggagaaaacgttgcggtagaaatgcaccgtgcagcgctggtatttggcgtccgggaacacctcgcccacggcctccagcatccccatgcacttgtcgccgacgatgagcttcacgccatccaagccgcgtccgcggagccactggaagaagctgacccagctggccttgtcctccttcatgccctctgcggcgcccaaaacctcacgaaaaccgtcctcattcacggcaatcgccaccaaaacagctacattttcgtactctccgccccagttgcggcgcaggtagatgccgtccacgtagacgtatggatagtggccgccctgcaaggggcggttgcgccagtcctcgatgtgaacgtaggctttcttgttcagctcgctgatggtggcgggcgataccttgctgccccacagcgcctccgtgatgtcctccacacggcgcacggaaacgcctgccaggtacatctcgatgagggcctcctccacgctgctctcccggcggcgataccgctcgatgatggccgtctcgaaggatacgcccttgagccggggtacgtggagcgtgacgtcgccggaggtcgtggtgagattgcggtcatagtgaccgctgcggtagccctgacgggcctcactgcgctcatagcgggccgcctgcgtcagcgactccgcctccttttccaacagctcgtttagggtttcctccacgctgccgcgaaccaattccttgatttgccccttgataatttcctcattcagctgtacaattttctcggacatagtttgctgtctcctttcgaatgtttgtgtggtaacttcattctaccagagcctgcaagctatgtcttcttttttgctcttttcaatttgcgcaacttattgtaccttatctttttcacagtacccatgacctgcaccagctaaaaaaagtctgttcccagcagcggagcaatgcggtcagaagtatgcactataccatgtaactaaacagcaaaatatactctattacgctcgtatggctttatgccgtccgggcgcttttttgtccctgtggagccggaacatcgggtcagcatggctcgaactttatccccggtgccgctccccgccgccccattcagatttacccaaaaaatctgaatggaggaaaggcagatggaagttaccatcaattataacggacaagctgtggccgtggaggttacgctggaagtctatgaatttcttgaccgggccgatcataaaacggagaacctgttccatgaacagcggcggcattgggatggccgggagtttgacgagtacatcattaccaccgagggcgtagggggctacggcgaaacgccggaggaatacctttgccgcatggaaacgctgcatgagctgatggctgttctggacacctgtaccgaggcccagcgccgccggttcctgctctatgcgcttgacgggctgagccttgcagagatcggtgtgctgtgcggctgctccaaagtggctgtttatcaaagtgtggaagcggtcagaaaaaaatttataaatttctttgagaacaggcttaacgaatgacctgttttctggctaccaagtgaaagggatcatttcccttatctcagcgaggggcggacagcggacgagctgcccgcctctccaattttcaggaggtaagcctatgaaaacaatcaatctgcggtggatgtatccccactaccggcatgacgagtttgtggatgttacggacaaggtatgggcagcgatgtatcaggcccagcgggagatggagaactatgagcgtcggaaagtctaccaccgcgcctactactctctggacgcatacagctggctggaaaattacgcactggaacacagcagatcgccggaagatattttgctggaacgagaagaaatgaccacccgcctgcacctgattgcagctctgcctgcggctctggctcatgccactccgacacaggcccgccgtgttcacgcctactacattgccggtatcaagcagccggaaatcgcccggagagagggtatccatagcagtaaggtcagcgttgccatccaccgggggctgcggaatatgcgccgctgctatgatgacctttttcaaacagagtgagggcgtgcctatgcagaccatcaatctcaaacaatattatccattttgcaaagaggacatttttgtggaggtgtccgatgagatcgtcgaagcgtttcttctggataagagggccgaggccgccagagatcgcaagatgttccggtataaggcgttttattcccttgattgtaacgatggaatcgaaaatgccgccatcggctgggcgcagccatcgccggaggactacctgatagaaaaagaagaattagccgaatacgaagaactgatacggcgattgtacgaagccatttcttccctgccgcctatgcaggctcgccgtgtccacgcccgctatatgctgggtatgaaagtgaaagatattgccgcaatggagggtatcacaccatcacaggcgggaaaatccatccacgctgcactgcggaggctgcgccggtactttgcgcgtcagaaatggacggtcaatctatgagtatttccaaagaaaagaggtgcctgacatgaacgaaaaaattacagcccacccccaaaaagaagaacgggagaaagtcctgaaggagatccggcagcttgaaaaccgcaagaagattttagagaacaagcagcggaatgaagaacgcaggggtcgtacccgccgcctgattgagcgcggagccgttttggaggggattttcccgctggctcccgacctttccggcgcggaggtcaaaacatttctgattgccctgtcccatcttccgggggctgcggaattgactgcaaacctgccaaaatccggggacacgccataagtcccttgtttacaagggcacgccataagtcccttgtttacaagggcgcacttatacaccgttgccggtgctgtgcgccctgccgggggcattgcgtacttcgtccgcgatgggaagctacgctccccaaaccccttgtgcgctctgcacagccaaacacccgctttgcgtttgtccggctccacagagcctgttatgccctcactgaaaggaggtgttccccatagatttctgtcatatccccgtcagtatcatcaagcgcagcgcaggccgttctgctgttgccgcagctgcttaccgcagcggaaccaagctgacaaatgaatgggatggaatgacccacgactacacccggaaaggcggcattgtccatgcggagatcatactgcctgcccacgccccgccggaatttgcagaccgatctatcctctggaacagcgtggagcaaatcgagaaagcaagggacagccagcttgcccgcgagattgaagcagccctgccccgtgaactgtccggcgaacaacagctcgcccttgtgcgtgcctatgtgaaggacaactttgtagacaaaggaatgtgtgccgactttgctatccatgataagggaaccggcaacccccatgttcatatcatgctgaccgtccggcccctgaaagaaaatggcgcatggggcgcaaagtgccgcaaggcatacgacctggacgaaaacggccagcgtatcccggacgggaaaggcggctggaagaaccaccgggaggacaccaccgactggaacgacaaagggaatgtggagatttggcgggcggcatgggcggcctgcaccaaccgggcgttggaatctgccggcagaccggagcgcattgaccatcgcagctacaggaggcagggcattgataaaatcccctctgtccatctggggccagctgccagccaaatggaaaagcgcggcatccgcaccgacaagggagaagtaaaccggcagatcgccgccgacaacaagctgctgaaagaaatcaaagcccgcattacccgtctttatcgctggtcgaaagccgaaacggaaaaaccacaaacacagcaaagcagcttgaccgccttgtgggaggcccagcagcagttggacgctccccgcacccgcaccggcaaaatccgggctttgcaagaaagcgctgcactattcagctttttgcaggcaaacggcatccagtctatgcagcagcttcatgaaaaaatcactgatatgaacagccgttactatgacctgcgcggaaagatcgtcaaggccgagcgccggatcactacccttaccgagcgcagggagatgtgggaacagtacaaccagtacaagtccatccacaagcagcttgccaaagtaaagccggaaaagcgggaacagtttgagcagcgccacagccgggaactgattctgtatgacgcagcgacccggtatctgaaagacttgaaagacaacggcgaggcaatcaccccgaagacatggcagctggaaattgaccagctggccgctggaaagcagacggacacgcttgccatgaaatccatgcgggaggatttgaaagcagtggaacggctccgcaaaaccgccgagcagctgtccagacaggaacgggacaagtctcacgaccgggagccggagcggtaagggctaccgcgtttcacgacatacttttgcacacagaaaaaccgccgtacaggtttccccatacggcggcagactgtttatttgccgaacaagtcgctgtgtgtgccggtgcgggccagcgtcagcaccagaacatcctcttctatgcggtagacaagcagccagtccgggagaatatgacattctcgatggcctgcccaatcgccggacaaatcgtgatcgcggtttttatccggcagcggttcgcccatcgacagcagcgccacgacctgttccagcaattcgattttcaggccgcgcttgattgcccgcttgtagtcctttttgaaagcggtcgtgtacttgacggtgtactttgttttcctcattttttcaggtcggcaaacaactcgtcaaggtcattgtatccctttacagacgggtcttttgcaatcctttccgcttccagcatggcagcaatcgtttccttgttcggctgttccagccttacttcaaagggaatgccgccttcacgaagcgactggcgcacaaagatgttaaacgccgtagtcaggttcatgccaagctcagtaaacagtgcgtccgcctgcgctttcaaatctgcgtccatgcggatactgatgtttgtggtatttccagccatacgatcaacccctttctgctggcaattatagtatatgccatttgcacgaagaaaacaatactttgcacgaatatttaacaataaattcattcaaggaggttaccggctttatgaaagaaatcatttatgaagaacaataagtctgaacctatcccagtcatggattaccgccagtaccgcagagtgcggaggctggtgcatgagtgctgtaactacatcgacggaaactgtatcgccctggacgatggggagaaatgtgtctgtgtccagtccatttcctattccctgttgtgcaggtggtttcgggcggcggtattgccgcaggataaggaactggaaacggcgctgttccaccggctgaatgctaagaaatgctccgtatgtggggcgctgtttacccccggttccaaccgagccaaatactgcccggaatgtgccgcacgcatgaagcggatcaatgccgcaaagcgcaagcggaaacaacgggagaaatgtcacgctttaggggctgaaaaacctttgtaaatcaaggcttttttcgagggtgtcaaaggcaggctgatagatttatcctctgacccataaaacggccttaaaatgcgtgcagaatcccaagagaaaccccaaggaggaaccctatgtcagacaaccgaaaatattattacctgaaactcaaagaaaactattttgacgatgattccatcgtgctgctggaaagtatgcaggatggtgtgctgtattccaacattctgctcaagctgtatctgaaatcgctgaaacatggcggacggcttcaacttgacgaggacattccttacacggcgcagatgatcgccaccattacccgccagcagatcggcactgtggagagagccttgcagatctttttgaagctgggtcttgtggaggtgctggacagcggcacattctacatgagcaacatcgaacttttaatcggccagtcctctaccgaggccgagcgaaagcgtgcggcgaggctccaaaacaaggctctttccgcgccccggacaaacggcggacatttgtccgacattcgtccaccagagatagagatagagttagagaaagagatagagataaagagagagatagagaagggacgctccgcccgcgcctatggccgttaccagaatgttttcctgacggacgaggaactggcagacttgcaggccagttttcccactgtatggggccagtacatcgaaaagctgtccgaatacatggcctctaccggtaagcggtatcagagccatgccgccaccatccggcgctgggccggtgaggacgcgaaaaaggcggccccgcccacccgcaaccgtgattacagcgtaaaggaggatgaaaccgtatgatggagattaccgcagaaatccgggcgctgatcgacaaggcagccgccggtatggaactggccggggacgagtacatagacccggcagacggcctcattcactgtaaaaagtgcggcggccagaggcagaccgttgtgccatgctttgggaaacccggctacttcatgccccgctgtatctgccagtgtcagcgggaggccgaggaacagcgcaaggccgccgaggaacggcagcgccgcatggagcgcatcaagcgccggaaggcccagggcctgcaagaccgctatctgtacgactacacctttgccaacgacaacggccaaaatcctctgatggacaaggcccgcgcctacgtggagaactggaaggaggcatacaggaacaacaccggcctgcttctgtttggggatgtgggaactggcaagtcctttttcgccggttgtatcgccaatgccctgcttgaccgggatgtgccggtgctgatgacgaactttcccaccatcctgaaccgtctgacgggaatgttttccgaggacagggccgactttatcgccagctttgacgagtacgacctgcttatcattgacgatttgggtgtggagcgcagtaccgagtatgcgatggagcagatgtttttcgtcatcgacagccgctaccgcagccgcaggcccatgattatcacaacaaacttgaaactgtccgagctgaaaaacccgcctgatctggcccacgcccgtatctatgaccgtattctggaacggtgtgcgccgattctttttgacgggaagaatttcagggaagaaaatgccggtgctacccgacaggcagcaaaagacattgtaaacagtaagcaagactgattttttactgggcggcacagacccgcccggagaaaggagcgccatgaacaaagaaccccgtactatgcaggtggcagacgccgctactgcgtccagagcgccggaaaacacgccggcgatggtaaagaaaatcggcaagacgacctacaaggttcatgtccatttcagcaataccagcacagaaaccatgagcgataaaatcaagcgtatgctcaaaaatgaaattcagcagatgtgacagactgataaacgaagccgccttgtgctaaactgatgatggtacgcaccaaaatttttgtcaaggaggacacgaaaatgctttacacagaaaaagagaaacatgaaattgagcgagtaaaggaagtctttgcggaacatctgcggcaaagccctgattttgaactgctctggtcggacaaggtgggctatgtctggctgacgattggcgtaaatcctgtctatgtggataccggtatcaggatagaatctgccgctgatctctgctgcaagtgtttggatgatgttgctatggatgttttgtatatgacgggcaacgatcatgcactggaggaagccgatccgctggaattggccgaaatcaagcggcgctgggagccatatatcaaccagctgccagactatgcgtatctctgcaaagacctgctggacggaaaaatgtaagctgttaaacgaggtgtcaggagccatacggtgcttctggcaccttttttgtgaatttgattaaaaagtccttgacaatttgtctctggaaaaacagcgaagtcgattctgattagctgcggtgcgaggttagcaccatttgatataaaagagctgcgtgacctgatggaatatgatgaactggagcttgacacgctgggagaggaaaaaacagcgttgttcgttattatttctgatacagatgctacgtttaactttgtggtgtctatcatgtattcccagctctttaatttgctttgcgacaaggcagacgatgtttataacggaaggctcccggttcatgtgcgtatgctccttgatgagtttgcgaacatcgggcagattccacagtttgagaagctgattgctacgatccgaagcagggaaatatcagcttctattattttgcagtcaaaatcacagctcaaagcgatttacagggacaatgccgataccatagagggcaactgcgacactacgctgtttctcggaggaaaggaaaagaccaccctaaaggaattagcagaggtattggggaaagaaaccattgacctgtacaacacctcggatacgagggggacgagccagtcctacggtctgaattaccaaaagaccggaaaggaactgatgagccaagatgagattgctgtcatggatggcgggaaatgtattatgcagcttagaggtgtcagaccatttttctcggataaattcgatataacgaagcacaagcggtacaaagagctgtccgattatgacaagaaaaatgcctttgatatggaacagtatgtgaaacatctgcaccacttgaaggtcacagaaaagacaaaggtagatgaagcctttgaatgcggggagatttccccggatacaactgaataggaacatttggacacgatgtccagaggtacaggagttttgcggatagaaagcaatgctccttattttttgcaaaaaataaattttcggaaagaacgaggtaactgaatatggcattttttacatcagcagtaacaggattaaagaccgttgtaaccgcaatcggagcaggcgtggcagtatggggcgttatcaatcttcttgagggatacggaaatgataacccaggggcaaaatcacaaggggtcaagcagctcatggctaattagatgtaataaaagcggagaaaggaaaagcacaatccagacggaaccggcggtgtagtcaagaaatattgtggaaacgcaagatttctgctataatgggtataaaacacttgacgatggaaagaaaggcgggaagcctatgcacattagttatcagccactatggaacacactgaaagagcgtggcatgaggaaagaggatttgcggcttgccgccggtcttaccacaaatatgattgccaacatgggcaagggaaagaatatcagcatggaaacgctggttcgcatttgtgaagccttgaattgtggtattatgaatgtgattaaattagaacaggacaatatctaaagcgatataattttatatttgattcgatttgcacaaaaaattaaattttaattgtgtatattttctattgtacccaatgtaaataagtgctatcataaaataaaacaagtacatttgaaacattttatgatttgagagtgtgcttgcaggttagtagcatattgccaataactgaatacaaaaaatgtaggttctggtcattttagaaaggagcattgtttatgaaaaaatttagtaaaagattgtttacctcgttggtagcgttttgtatgcttttttctgtgagtgcggttcctgcttttgcagcggaaacaacaacggaaataacggatactcaacagccggtagtcattggagaatatgacggatacttaaccgatgttatgatttccgatggtgtcaccaaaagagcagtcgctaatgttcgtattaactcttatgcaacttatgatgaggatgatgggattcaagttcatgtgaagttgtatgtaccgtggtatgaatctccaaaaccggagttcactggtatgactggtacagttaatgtgcttatgaacaaaaaatccaccaatacggcatttgcagaattagccgacggtgaagaaacaatcgaaactgatgtggatactggaagaacaggtaatagcggagataagggaacggtttctgtttctggtgttgctaccgctaataatgccttggcaggcggtggagctttcgctatttcttaccctgtgacacttccctaattaaatgcaaaacagttgtgaattaaggttggtaataggtaaaatgaaacggttattggcaatatgcgtatgtttttttatgtgtgtaggcttatgttcgtgtgattcttcccaaactcggtcggtatcatcatataactggtctttagaatttattactgatttagatggtaatatgttattctcaggttcagtgcatgatgacataccagtattggatttgacattgagttttgaagaaaaaagttttatcttaacagataacactcataaacaagaatggacaggtacatattcgcttgaaaagattgacaattcttcttcgaaactcggattaacttttgaaaatttagaggagcctgttacaggcgtatatggaacaagagtttattctgatgattcagaaagcgcaacaattacattacaaactgatgaaaatatcctgtcttttgttggagaagattcataaataaaaacagccgctgtaggaacaaaatcctacaacggctgtttttatttccacggcctgcgccggaagttcataccagactgttttatcagcggggatttcttgaacagctttttcaaaaggcttcgttcctcttgtgagagccgcttgtatttgagccggaacgccttgcagaatatctccgtgaattgctgaaccctgtcccccggagattgcatggccttttgtacttcccgtataagttcatcggcaggcgtggtatccggcgcactttcgctgtcattttcgtgcgccttgcgtatatcatggagaatgacgtcccatgttttgtgcgtcacatggcagaaaaaatcttcttcctctatctgacaggcttccaacactttgattgcccggtctgccgcagcttcggggtgttcttccagtaccatagcccgtaaagcagccagtgagctgtttgtgtcatggaagtgcatggttgctatcccgtccacatagatttctgcgtctgccagcaattccttaaatttttcatgggagataatctcacacagcagccggttattgaagcgttcacttttcagcagttccacgacttcatcactcaaatgtaattcttctatcggggtgttttcatatctccgattattggtaaggccgagcagatagtcaaccgacacctgatagaagtctgccagcttcaacaggctgccgtggttaatttccttgtattcgtcgttgtcgttttcataactgccgagggctgattttgaaatgccggtttcctgtgccagttcttccagattcaagccccgttccacccgtaaatctttcaggcgttcctgtacggaaatgcgggttttcataaacacatcgctccttcctgcggctggctgccgctgttattccttattataccatataccgttccgaaatcgtggaatttttcgattttggggcggttttcctattttatggacatacgggaaagggttcaaaaatgagctatgattaagtcagttcatcgatggattatttccaatcgaatgaccggcctgatgggatatgctccccggcgatgtagcgcaacgacctgcggcaaggaaatggaggaaccttgaccgcagcgagcgtaccaacgggaacgaaacgccgctgtgagattcaggggcaggaacgacagcaggacaacccggcagaactgataccaaaacgctacccaaacacgacaaatcggcggggtgtagtctgccccgtccgtaatactatggggcatttcaaagcggctctatggccgtattttccttgaaaatcgccccgaaacatgacaccaaaaacctttatccgcctgttcccgttgttacggctgaaatgggcggattttctatgataggaggcactatgccgagaatgagcaagaaacggaagttggagctttccttcttcctcaatgaccgggggcgtgtggcctacaacgacctgtgccggaagtgccagcataagtgcaagcagagtttccgggctgtcgtgatagactgcccccattacctgtcaaaacgagccaagcgaaaggagaaaatcagttaaatggaatttgaatttatgagcgcagacacggttctgccgccttgtatgccgctacccgccgcaatgcttcggctgccgatcagcagcacagcaaaagtcatgtatgcccgtctgctgaacaccacccttacggcagggatagaggatagcaacggcattttgtttgtccgttttcctatcatggaattagcggcagccctctcccgcagccccgtcactgtgaagcgttccctgaaagaattggaggacatcgggcttatcctgcgggtgcgccggggtgtgggagaaccaaaccgcatttacacgctgcttcccaaaggagggctgccatgataaatgagaagctggaaaagctgaatcaggagattgccaaaggcgaagccagactgcggcgggcgcagcatgaagaaaaaatactggaacaccaggtgaagcagcttacccggaaggaacggacgcaccggctctgtaccagaggagctatgctggaaagtttccttttaaggccggaagtgctgacagacgaggatgtgatggacattctgaaacaggcattttctcaaagtggcatgaaggaaatagttgcagaaagcgtgaaagggcgggtagccggggaatcccttacggagtaagggcgcaactatacaccggtcaagccggtgcgttgcgccctgccgggggcttcctgcggaaagcggatgattttcagcaccgttgcggctgcttccaatcatcacaggggacgctacacttcccctgcgctggctgcgccagctacccctttgtggacttgccgcccgggaacaccttgcgctgcaagctgttcccgtccagcaagtttacaatttatctattccaaaacaggactgcccgtagtataataaagctaatgacgaacactatctaaggagatggttttatgtatggattgattgctttgaatttcatcataccctttgttatggtttttgtaggatatatcttaaagaagcacccggtaaaagatatgacatccggtaacggatacaatacgcctacatctcggaagtcacaagagcattgggattatgcacaaagcatagcacctaatatttttattggtattggcaaaacattaggtttggtagaaatcgttttgtgtatatccttacttcttcttaatatttctacacagactaccgtatttgcaggagtagttgttggaattatttttctgatttttggattttataaaacagaaactggaattacaagtaaatttgcgaacaaaaacttttaagctattagacagctttccatcatcgagccaacctgacccgaaccttcaaaactgaatactaatcgcctaccagcgacaccactaagcaggaaatcagaaacggtttcctgcttttcttttgcccaaaatcaaccacaggaaggaggaacgctatgccctgtccacaccatgatataaaaataatccagcgcagcaaccaccagtcagccgttgcgtctgccgcctaccagagtggggaacggctgttttccgagtacgaccagaagcagaaatactattcccataaaagcgagattgtccatacagaaatcatgctgccgccccacgccccaccagcgtatgcagaccgcaatactttgtggaacgccgccgaagctatcgagaagcaatggaactcccagcttgcccggagaatcgtgcttgccataccgagggaaatccccccggaacagcacgccgaccttatccgggactactgccgggagttttttgtttctaaaggcatgattgccgattttgccatccacgacaaagggaatgggaatccccacgcccacatcctgctgaccatgcgggcaatggacgaaaacgggaaatggcttcccaagagccggaaggtttatgaccttgacgagaacggcgagcgtatccggctcccgtccgggagctggaaaagccacaaggaggataccgtggactggaacgaccagaagtacggagagatctggcggcagggctgggcggctaccgctaaccgctatctggaagccaacggacgcccggagcgccttgaccttcgttcctatgaacggcaggggcttgataaaatccccaccgtccatatggggccagcagtcagccagatggagaaacgagggatacagaccaacatcggcaacttgaaccgggacatcaaagccgccaattcccttatgcaatctatccggcagatggtacgccacctgaaaggctggattgcagacctgaaggagaaaaaagccgccctgctggaagccttgcaggaatcgaaggaacccaccctgccggagctgctggggaaatatctggatttgcgccgggaggaacgtacaggctggacaagcaaaggccagcttacaggcagcgttgccgatttcaacaaggttatggaagctatccgctatctgcgggaaaaggagctgtccactgtgcagagtttggacgcttatctggataccgtcagcgggcaggccgtttccatccgggcagagatgaagccgaaagaacagcgtatgaaagaaatcaacaccctgctttcccatatcgccaactttgaagcccataagccggttcatgtggagtatgctgccatccggtttaagaagccacgggaacagtttgccgccgcccatcgggacgagctggacgcctataatgccgctatccgttatttcaaggtgcatttgaaggagaagaagtacagcattaaaaagctgaatgaggaacagacacagcttgccggagaagttgccggatataaggaacggttgtccgcattacaggaggatgtgaagattctccgggatgtgcgtcactggctcaatcaggttcttccgtctgaacagtaccgccagaccgccgagccgggaaagaaaccgtccatccagcaggcagtcaaaggccggacgcagcgtatccgggaagaacaggccgagaaacggaagcagccccgcacagagaaaaaacaggatatggaactttaataggcgcttgctattttctttttcgagaatgacaggcgcttttcttattttcaggaggatttatttgaatgtatttaaagctgtcaagcagtctgttaccacccggcaggctgcggagcattttggaatccgggtgggacgaaacgggatgtgtgtctgccccttccatgctgataaaaaccccagcatgaaggttgaccggcgctttcactgtttcggctgtcaggcagacggggatgtgattgactttgtttcccgtctggaagctgtcagtccgaaggaagccgccctcatgctggcgcaggagttctccatcccctatgaggacagggaaccacccggcaggagaaaacccaaaccccggcaggaaaccccggaacagcggttttgccgcatggagcgttactgcttccgggtgctgtccgattattaccatcttctgcgccgctggaaacgggactatgcccctaagatgccggaagaagcatggcacccgctttttgtggaagccttgcagaagcaatcccatgtggaatatctgctggatgtgctgctctccccggatatggaggaacgggcagtccttatcgttgactatggaaaggaagtgagcaatcttgaaagacgaatggcagagcttgccgcccaagatacggcaggccgcagaacagaccatacaagaagcagccccgccccggagcattgaggaagtaaaggccatgctggaaagcaccgagaaaggcagcgtccgcaacagtatccgcaactgcctgaccgtctttcagaatgacccgctgctttccggggcaatcgcaaaaaatctgctgaccgagcgagtggacattgtaaagcccatcggctaccaccgcatcggcaccgccatcacggacacggatatgaactatctgctcctgtatctggaagaaacctatgggcttaccagtgagaaaaagattaccgccgccatcgggattgttgccaatgaaaacggctaccaccccgtccgggactacctgaacggcctttcatgggatgggcaggagcgtatccgctattgcctgcgccactttctgggagccgacaccgaccagtacacctatgaagccctgcggctgttcctgctgggagccatccaccgggcattttgccccggctgtaaatttgaagtcatgctctgtctggtgggcggtcagggagccgggaaatccacctttttccggctgctggcagtaaaagacgagtggttttccgatgatttgcggaagctggatgatgataacgtgtaccgcaagctgcaaggccactggattatcgagatgtcggagatgattgccaccgccaatgccaagagcattgaggaaatcaagtcatttttaagccgacagaaggaggtctataaaatcccatacgaaacccacccggaggacaggctgcggcaatgtgtgttcggcggcacttccaatgcccttgacttcctgccccttgaccgttccggcaaccggcgcttcctgccggtcatggtgtacccggaacaggccgaggttcacattttggaggacgaagccgcttccagagcctatcttgcacaggtctgggcagaagccatgacggtttaccgcagcggggattttaagctgtctttcagcccggaaatggtgcgctatctcaaagaacaccagcgggatttcatgccggaggacaccaaggccgggatgatacaggcataccttgaccgctataccggcggcatggtgtgttccaagcagcttttcaaggaagccctgaaccacccctttgacgagccgaagcaatgggaaatccgggaagtcaacgacatcatgaaccattgcgtgacgggctggaattacttttccaacccccgtgtgttcccggaatacggcaggcaaaagggctgggagcgtgaaacgaaagcaacggacatcagcaacggagctgaaaaaatcccggaaggatttgaggaagtcacggaacagatggagcttcccttctgaaaaatgcagccggttgccgaccctgttgcactcccgttgccgagccggttgccgggaaccccccgtaactgcgggcttttccccttatcagcaaccaaaacaacagaaaaataaaagaaaataaaaataagagccaaactgccagacagagatagttttcaggttttttgaagcccgttgccggacttcgttgccgaccttctccttgtctggcttattctattatggaggataactgcctatggcaaaaacgaaaacagagattcatgttaccacagtttttgacggcgaactggacgccacagacgtctttgtgagcctgattgcccaaaaatatgggcagaataccagcaaagaaaatcttgcgaaaacacaagatttagagtataataaggatgaggttcagaagaaccgtgttccgtctggattgtgcgggtaaacggttatgatgaacggatatgaatatacagacatggacgcaatactggcaggcagcttccgggcagccatctattgcaggctttccaaagacgatgaccttgacggggagagcgccagtattgccaaccagcgggatatgctggaaaaatactgcgaaaagcagggatgggaggttgtggcagtctatcaggacgatggctacacggggctgaacatggagcgccccgacctgaaacggatgctcaaagccatcgagcgcaggcagataaaccttgtcataacgaaagatttatcgaggttgggcagaaattatttgcagaccggcacactcattgaggacttctttccccgccacggcgtccgctatatcgccatgaatgacggtatcgacaccatgcgggagaataacgacattgcgccgttcaagaacatcctcaacgagatgtacagcaaggatatttccaagaaggtacattcctcttaccttctgaaagcccagcaaggccagtttaccggctgtatcgcccctttcgggtatcagaaagacccggaggacaaaaaccatctgctggtggacgaggaaaccgcccccattgtccggcaaatcttccgctgggcgctggaaggacacggcccgaactttatccggcgcaggctggaagaacagaaggtgccttgccctacatggtggaaccgggaacggggcttccgcaatgtccgcactaaatgggaaaagaaagacccggtaaacgggcggtatatgtgggatttttcggtaatcaaggacatcctgatgaatcccgtctataccggggctatcgcttcccagaagaaggactaccgcttcaaaatcggcaccatcggggaaaaaaagccgcaggactggattgtggtggaggaacggcatgagccgattgttgaccgcaagagctttgacatcgtgcaggacaagctgaaatcccggcagcgttcccgccagaccggggaaatcagcctgtttgcggggcttctcaaatgtggcgagtgtgggaaatcactgactatccgctacaccaacgacaagcacccgaagcagatttattcctgtaagacctataatgcctatgggaaacagcactgtacccagcaccgtgtggagtacgaaaccctttaccgccttgtgctgaacaaaatccgggaatgtgcgaaggccgccctgatggacggggaagctgttgccggacggcttaccaacacctgtgaagccgagcagaaaggccagcgggaagcgttggagcgttccctgacgaagcacgaggaacggattgaggtactggaaaaaatggtgctgcggctctatgaggacatggttgccggacgtatcagcgaagcaaacttcaatctcatgctggataagacgcagaaggaacaggctgaactaaaggaacgggttgaacaggggcgcaggaagctggctgatgaaatccgccttgccgtggacgccaagcaatgggtggacgccattcaggaatacgccgacatcacggagctggacgctgccaccctcaaccgtctgattaaagaaatcgttgtccatgaacacatcgacagcgataagacacgacacatttctattgaaattcattttaatctcaaacccatcccggaggtggaacaggtcacggcctgacctgttcccgccggggcggttctaaaaaaattccataaatttcttgacacgccgccgcccgccatcgagcagagttttacacctattttggtatgaaacagctcatggcgggtggcggtattgtaattgtggcacagacggtaattccgcagcttacaagcctgttttcctaagtcatgggagcgattctcgacaagataactgaatttataaaggaaatactgcaagggtgggtcatggacaaccttactacgatgtttacagatgtgaatgataaggtcggaacaatcgcaggggaagtcggcaggacacccagttcatggaacagcggagtgttttctatgatagagaacctttcggaaaatgtgatgatacccatagcgggcatgatcatcagtgcgatactctgctatgagctgattacaatggtcatggataagaacaatatgcatgaagtaggaagcgagttctttttccgttaccttatcaaagcctgtatcgctgtgctgcttctcagctacacctttgacatcacaatggcgatttttgatgtgggaaaccatatcgtgaccagagcaggcggtattgtttcgggttccactaccattgatgtgacggataccctaaaaaccatgtttgacagtcagattgatacaatgggcatcggcgagctgatcgggcttggtatcgaaactatgattgtcagcttatgtatgaaaatcatctccctgcttattaccgtcatgcttttcgggagaatgattgaaatctacctttatatttcagtagctccggttccctttgccacattcagtaaccgggaatggggcggtatcggcaacaattatatcaagggactgtgttcactggcgtttcagggatttttcattatggtatgcgtggcaatctatgcggtgctggtatccggcattgcggttgcggacaatctgcacacagcactgtggtcggtggcagcttataccgttgttctgtgtttcagcctgttcaagacaggttcccttgcgaaatcaatctggaatgctcattagaacacatttcaaagaaaggagggaacagccggggcttgcagtatcagctccggctgtgatgttatggcaatatccgtagcagtgccaaagaatttaagcggcataaagacaaaagtagcgttaaatctgacgaaacgccagcttatttgcttcagcggtgcaggtgcggtagggattcccttttacatttttacaaaagggtttatcggcacacaggcatcggcacttttgatggtagcggtcatgctgccttttttctttctggcaatgtatgagaaggacggatttccggcagagaagattctgtattttatgataaggcagaaattcctcacaccggggattcgtccctacaaatcagaaaatatttacagaagattagaagaaacagagcgtataaaagaggaggtgcgtaaacttgaagaaaaagcaggcggcagaaaagccggacagacataagaaaaaaggaaaaacgaagccggggctgacctttgtggagcggagaaggcttgcggagttaaaacacatgcttgccggaacgaataaaaacgcagaaaagcccaccacagcacagaagaccattacctttcagaagatgtaccgggacggtatctgtcaggtcacttctggcttttatacgaaaatggtggagttttacgatataaattatgacctgctggaaatcgaggataagggggaaatactggaggaatacagcaggcttatcaattattttgacccgtctattaaatttgagctgttcctgttcaaccgacaggttaacgagcagaccttaattgaccagtttgacattccattgcaggcagatgattttgatgatattcgtgaggaatacacgcagatgttaaagaaacaggctgcaaagggaaataacggtattatcaaatcaaagtatctgatttttggaattgagagtaaaggctttaaggaggcaagggcaaaacttgtcagcattgaagcagatgtgattaaaaatttgactaatctgggcacacacgctaagagccttgacggaaaggaacgtctgcgtatcctgcatgagtattttaaccaggatactatggagcctttccgtttttcttttaaggaactggcggagtcgggaaaaagtgtgaaagattacatcgctccgccgggatttgattttcgctatccgagtcgttttaaggcgggaaaaatgtatggcagtgtgcattatctggatattattgccccgaagtttgatgatgagttgttgaaaaagcttcttgatctggatgcgaacctgactattaccatgcatatgcagacaatggatccggtcaaggcgattaagatgctaaaaggtgctttgacgaatattcagaagatgaagattgaagagcagaaaaaggcggtaaggtcaggttatgacatggacattcttccaacggacattatcacttatgaaaaagatacccttgaccttttggacgatttaaacagcagcaatcagaaaatggtaaagatgacatttcttctgacctgctatggcagaaacaagcgggaactggaaaatatcacgcagagggtatccggcattatccaacaggcgaactgcaacctcagatgtatgcagtatttacaggagcagggactgatggcatcggcaccaatcgggtgcaacgatacgggaattgaacgggatttgacaacaaagagtaccgctatcttagtaccgttctgtacgcaggaattatttatgccagctccggctatttattatggtttaaatgccctttccaacaacatgattatggcagaccggaaacggcttcgtacaccaaacggtgtgattcttggtacaccgggaagtggtaagtcttttagtgcaaagcgtgagattctttcctgtttcctgatgacaaaggacgatattgtggtctgcgatccggagggcgagtattttgcccttgtgggagcattgcacggacaggtggtaaggctggcaaccaattccaaagattatttaaatccgatggacattcagctttcccataaaggggataaggaagccttaaagctgaaatccgattttatcattactctgtgtgacttgattgccggaggaaagaacggtctggaaaatgatgagaaaggtatcattgacgaatgtatccgtcatatttacgatgcttattttgaaaatcccgtaccggagaatatgcctatccttgaggatttgtataatgccctgttagagcataagaacaaaaaggcagaacggattgcaaactcccttgtgctatatgtgcatggttcgcagaattattttaaccacaggacgaatgtagacagtcagaaccgtatcatgtgctttgacatcagggacttgggaaaccagttgaaagagcttggaatgttaatcgtacaggatgcggtctggaacagggtatcgcagaaccgggagcgtaagattgccacccgctattattgtgatgagttccaccttttgctgaaggagaagcagaccgctatctattcggtggaaatctggaagcgtttccgtaagtggggcggtattcctacggggctgacgcagaacgtaggcgattttttgaagtcggaggaaatcgagggaatcctcggcaattccgattttgtatatctcctgaatcaaaatgcaaaggatcaggcaatccttgcagataagctgggattgtcagaaaaacagcttgcccatgtaaccaattccgagccggggtgcggactgattctgtttgacaacgtggttattccgttcgtagataaatatccggtagataccaagacctttgcggttatgaataccaaaccagaggaaagtgtaaggcaggaggtaaatgagtagtggcggagaaaaagaaacagaaaccggctgcatttgcacaggagaaaaaaacctttaccggagaaattccaaagaaagcaaacgagggtaaaggtaaaaaatccgcagcatatcagccgagagatgcagataccacttctggacacgatgtccagaggtcgaaaaatacaaagaagtatcagaaagcagatgcttctggacagaatgtccaaaagtccgagggagcagaagccggagagaagtctaaaagcgattttatgcagccggacagcacttttacggaggaagccggagaggagcagggtagaaaaattgccagcgatgactaccgccacagggacacctatcattcgtcacagaaaaagggcaggtatcaaaggcgggagataaagagccgggagcgagtaaagcaatttgattttgaacaggatttccagacaaaggacactacctttaccgaagaggcagaaccggaatttcatggaagcaaaaagttagaccgactgcaaaagaaagcggagaaagccagaaaaaagacggaagctgcaagaaagaagattccaaagaaaacggagtattctctggagcgtgtttttgatgaaaagacgggcagaacaaagtatgtattgacttctgtaaaaaaagagaaaccattcaaaccggacagtccggtaaaaagagcggctggcagggtgggaatggaatcttctaattttgcccacagtaaggttgccgaagtggagaaagaaaattccggtgtggaggctgcccacaagacagagcagagcggggaagatgtttaccgctttttcaaagggcattacaaagggaaaacggaaagacggagagcgaaagctgcaaagctggagaaaaagcagatgcagaaagaggtcaatttccgttatcagaagttcttggaagaaaatccggaaatgcaggaaaagaccattcagaagcagttgcagaaaagactgcaaaagcagcgtatcaaacgggaatatgcaaaagcaagacgggcgggacagacagcgaaagccgcaaaggaaacagcggcgaagtccgggaatctttttacagcggcagccagaaagatacaggagattgcatcaaaaaatgtttcgcttctgcttgccataggagccttttcggtgcttcttgtgatgattatgacagcagtatcttcctgtggggcgatgtttgccggaggaatcagtaccacgctggcaggaagttatatgagcgttccggcagaaatagatgcggcagatttagctttttctgaactggaaaaagaattgcaggcagagattgatgccatagaaaccacttatccggattatgatgagtaccgttataatctggcatctatcgggcatgacccatttgcactgatcagctatctgtcggcagtccatacggaatttactgcaagtgaggtacaggcagaaatagaatatctgtttgatgaaatgtatgagttgacactaaatcctacagaggaaacgaggacaaggacggtaacaaaaacaggcactcatacggtaacagacccggttacgggggaaacaacagaagaggaatacgagtatgaagtggaagaggaatataccgtaaccattctggaagtgaccctgacagcaaaagatttaaacgtagtagttgccggacgcatgaatgaggagcagagagaaatctatgctttttataaccagacccacgggctgacacagcagttttataagccccttgatttatattggtacaactatgtgagcagttattatggctggcgtatcaatccggtcacagggcaggaacagttacatcggggcgtagatattgcagtacctaccggaacaaccgtatatgcggcgatggacgggacagtaactaccgcaacttatgacagctattacggaaattatgtagtgattgaagatgaaaaaggctactgcacaaaatatgcccacatggataccttaaatgtccgggcaggacagagcgtgacgcatggaaatgtgatcggaacaacagggaatacgggaagcagtaccggaagtcatttacatatcgaatgtctgtatcagggggaatattataaccctcttttttattttgaagcaggcacggatacgctgtatggcgaaacgccgggcagcggaagcggcggaggaaatgtgataccgccggattcctatgacgatgcaaccgtgcaggcacttatggaagaagcggcgagatatttagactatccctatgtatggggaggctccagtccgtccaccagctttgactgttccggttttgtctgctgggtatttacaaacagcggtgtccataacctgccacgaaccacagcacagggcatttataaccagtgtacgcctgtgtcggcggcagatgcaaaggctggggatattatcttttttacaggtacatacaattcgggcgtaccagtcagccatgtggggatttactgcggaaacggggtcatgattcattgcggagatccaatcagttacgcttcaatcaattcgtcctattggcagagccatttttatgcgtttggaagattatcaggaaattaaaataacaggaagtgaggaacgatgacgaaagagagaattgtaaaggagctttccaaagtccgggaacagcttgcgggattgcaggcgagggagagggatttggcggaacagcttcagatggcagaggatgcggagaagatgaaattcattgaaaagaataaaatctctctggatcggctgattctgttaaacaaggtcagcgaagaagaaattatgcgtctgctgaaagaaaaagagcagaaagaagcagcacaatcagaagaaagggaggcttacagccatgaagaacaggaagttatcatctaaggcagttatatcactgatattgtccgctgtgctatttaccatgcctgcggtagcgttttctgtaaatgggaactacgcaatcagcgcttttgccgaagaaacaaaagaaaccgaagaatccaaaccggaggaaagtacggagcagacacccggcgaaagtgaaactgatgtcagtacggaggaaaatacagaaaacagtaccgagggaagcacggaagaaactacggagggcagcacggagggaagcaccgaaggcggcaccgaagagaatacagaaggcagtaccgatgaaagcaccggggatggcactgtatcgggaaatgataaaccggagccggtatgtaattgcgaagatcaatgcggtgcgtatgagtatgacaaaaactgtcccgtctgcgtcacagattataagctctgtacctataaaaaaccgaatgtgagtatcaaaatcagacagccggaggagtggcataatgacattgtttccgtttctttcagtgtaaaagataccgcagatacggggaattttgaaatcgcaaagatagaggcaaaggtagggcagaatggaagctggacagatgtgacggaggaaaagaaattaaggatttccgagaactgtaccgtgtatgtgcttgtcacagaccagaaaggcaatacctatgagaagaaccgtgccataaagtgctttgataccgtaaagccgaccttaaatgcggcagtcagtgacgggcttttaagcatacaggtacatgatacggattccggtgtaaaggcggtatatgtcaatggatatgagtttacagatctgacgggcggtacgttaaatatccgcctccagcagtttgacgcagggtatgagtattttaccatttctgcaatggacaatgccggaaatatgtctgaggtttataaaacgaaaaatccgtactataaagaccctgccgataccagtgatgggaatccggcggagcagctcccggagagtgcgaccccgacgaaaccggggagtgctacgggaaccgtgacggagcataccaaaacagacagtaacggaaataccacatcacagacaagtcctgccgaacagaaaaagcaggcaatgaaagaagctgcggaggcagaaagcgggaaaacagaaagtacggaaaaatccggtcagggcaaggagttttatactattcagaccgccacggagaaagttttctatctgattattgaccgggacggagaggaagaaatggtatattttttgactgaggttacggaaaatgacctgttaaatgcaacttccgataacagtgaaaccttgccgaaaaattccgctgcgttggaatctgcaattccgaatggggagagtgcattgccaaacaacaacggagagcaggcagatacagagggaaaggaaacggaaacagaaaaaggtacggaaggtgcagagagtacgggaaatacagaggaaaccgaaccggagccggaagtgaaagaagcaccgaatccgatgatttcgtatgtgctgattggtagtcttgccttaatcgttatcggagctgcttattattttaaggttgtccgcaagaaaaaagaggactttatcgaggacgaagatgaagatgaggaagataacgaggagtatgaaaacgaagatgaggaatcggaggaagatacggaagaagatttctttgacgaacaggaggaataaggtatgcagttggtggttacagagaagcccagcgtagcacaggcaatttcccatgtgatcggggcgaaagagagaaaagacggttacatggagggaaacggatttctcgtttcatggtgtgtaggacatctggtagagctggcacagccggagatgtattcagaagcatggaaaaaatggagctatgagagcctgcccatgataccggagcagtggcagcatgaagtgaaaaaggaaacagcaacgcagtataaaatcttgaaaaatctgatgcacgatacaagagttgaaagtgtggtgtgtgccaccgatgccggacgggagggagaacttatcttccgtctggtatatgaacaggcaggctgccggaaaccaatgaaacgcctgtggatttcatcaatggaggagagtgcaatccgtgacgggtttgaaaacttaaagccgggaagcgattatgacagcctgtaccagtctgcactttgcagacagcaggcagactggctggtgggattaaatggtacgagattatttactgtactgtatggcggaaaggtattaaaggtgggcagagtacagacgcccacccttgccatgctggtagaccgtgaagtgaagattatgaattttgaaaaagagcagtattacatggctcatattctgatggatgggatagatgccatgacagaacggattgacgataaggcaagggcagaaagtattgctgcagcgtgtgaaagtcagagtggagtggttcgttccgttataaaggaaaataaaagcgttgcaccaccaaaactttatgaccttaccacgcttcagcgggatgccaaccgtatctttggttttactgcaaagcagacattggagtacacccagagcctttatgagaaaaagctggtcacttatccgagaacggacagccagtatttatccgatgatatggaagaaactgcaaaagcggtaatcggggcagtttatcaggcgattctctttgaggaacagaccggagcagagccggatataaaaagagtgttgaacagtaaaaaagtgaccgaccaccatgcaattattcccaccatagaaattacaaagacagacctttccgctgtgccggagggagaaatgaaaatcttatcccttgtcgctaatcgtctgttatgtgcaaccgggaaaaagcagttgtatgaaacggtaaaagcagagttttcctgcggtggttacagctttcatgtatccggaaaaacggttctgcagaacgggtggaaagaatttgaagcagcattgaaacgtacctaccgggtagaaaaaacagatgaggataaggaagagaagaaactgccggagctttctgaaggcatgacgtttccagttatccagacaaaggtaacagagcatttcacgcagcctcccaaacattttaccgaggacagcctgctttctgcgatggaacgtgccggagcagaggatatgggcgatgaggtggaacgcaaaggacttggcacacctgccaccagagctgacattattgaaaagctggtcaaagacggttttgtgaaacgggagaaaaagcagatgcttcccaccgaggacgggatgaagctcattactgttctgccggatatggtaaaatccccgaagcttacagcagattgggagaatacgctgactttggttgaaaaaggcgaatacaccatgcaggagttcatggatggcattgaagatatggtgcgggagctggtgcaaacctaccacagtatcagtgacgatcagaagtctttgtttggaacgatgcaggaagtgcttggaaaatgcccgaaatgcggcagcgatgtagtaaaaggaaaattcggtgcttactgcaaacaaaaatgcggcatgaatgtgggtagggcaatgggagcaacgttttccgatacacagatgaaaagtctgcttgaagggaaaaagacccttgtgagaggattaaaagggaaaaagggaagctacgatgcgtacctgattccggagggaattgaggattattcttatatcaaagacggaaaggaaatcaaaggttcgcagtacaaattcaagatggaatttccaccgagaaaaagcaagtgaaaaggagacagaaaaatgaatacagaaatgaaaaagaccgttgtttacagcaccggagataaaattttaaacattatgaaagagcaggatatggatattccagaactttctttgcggtgcggtgtcagggaagatgtattgatggatattctggcaggtatccgggaagcagatataagtacgctctgcaaaattgcagacggactggagatttgtgtacgggagctttgccctgatgaagaaagctatgtcgttccggtggaaaaagatatccttgcaaagctcattgtgatcagcgagctgaaggagatggaattggaggagctgattggcacaattctggaaaacggtatcgaagaacacggtttttatgaataaggcggcgggggttatcccctccgtcattttggaggaatgcttatggtaacaaaatatcagatgatttcctatctggcggaggataccgcaaaagagatagcgaaaaacgggcaggagtggacaaggtatctgactaccgctgcaaggctttataaatatccgttcaatgaacagatacttatttttgcacaacgaccggatgcaacagcctgtgcgtcccttgaactatggaatgagaagatgaattgctgggtaaaccgtggagcaaagggaattgccctgctggatacggaaaattcctatacaagattgaaatatgttttcgatgtgtccgacgtacataaggcaaggcggataggacgtgatccgaatttgtgggagttgcgtgaggagcataaagaaacagtcctggcacagcttgaaaagacatacggagaaacggataaaaacagctcctttgaacagcggataatggaaatatccaatcggattgctttggattattatgaagaacttctgccggaaatcgaatatgtgaaagagggcagctttttagaggaactggacgagttaaatgtaggtgtcaggcttcgtgatacgctttcttccagtattgcttacaccatactgtcacgatgcggtgcagatatggaactgtggaaagacgagcagggatttgaatatatcagcgactttaatacgatgaaaaccctgtctgttgttggtacagccaccacagatatgtgcaagccgcttttaatggagataggcagaaccataggagcgtatgaccgccagattgcccgcaggaaggcacaggaaaaagctaatgcaggacgcacacaaacttctttggaaaatacggagaaagtgcttgcaaatgaagcagatacagactataatgctttaaagcgtgaaagcgaaaaggagctacaaaacaatcaggagatagaaatacagagcaaaaaggaggatgcggcacatgaaactgacatacgaaaagaacggggattatctgattccgaacctgacagcgaacgaggaaccggagggaacgctgacgaagtacggtatgatgcggaagaacttcttacaggaacaccggaaagggatttatcagggcatgatactggcgggcgagctgaaagcacactgtctggagatacaggagcaggcagagcagagaatggaagccctgagcgaacagatggcgaaagcagagggagtgaacgaggaactgaaagcagccgatcagatgaagtgggtagcgaagatgaacaacatcagacattcagcggaggagatcgtgctgacggaactgatttacagttagaaaatgacatacaggaagaagaaataccagaaccggatagtggagaacattcattatccggttctttttttccgaagctgtctgaaacagagcagggggaggacttacagcgtggtattttatgcagtgatgagttcctgaagcataaaagaccggaaatagctgggtattttcagatagagcaggatgcaaagattcaggcggattatctgagaaattcgttccgcatggaagaatacaccgagttcaatatcggggaaatgcggggcggctaccgtgccgatgaggacggtattaccttatggaaaggcaattatctgacccgtgaagcggaaagcaggctgtcatgggaggaagcacgttttcttgtcaattcctatatggaggacggagtatatcttcttccaggagaaaccgcagagcggattgaaacagcgggaatgtaccagcagcttgacttattttccatgtttacggagcaggctggcaatcttgccatgaaacaggcggaaacagtgacaccgatacggtcagaaacaaagataccgccggagcagatagcggatattctgcggagcggcggaggcagggataacagcagaaagcgtatctacaccaaatatcagcagggaaagacaccggaggagatggctgctttcttacagaaagagtatggaacaaccggaaagggctttgaatttgacggaaagcagttagcggtatggttcaatgaggatgggatgcgtgtcggatatggcacatcgacagagcgtccggtgcttcagatgaactggcaggaggtggaagcaaaaatccgctcacaggtagtaaacggtacctatatgggagcaaatgaagcttatctgactgacgaagcagaacgtgaccggattgcagggcatctctttttctttttccgggatggcatgggagaactgccggaggagcttgggctaaaagcaggaaattatccggaggctcatgcaagaatgatagaatacctttctacaaaagaaggagttgagcttgtggcttcccacatggatcaggcacttcatcagcttgaaaccggagagaaaaagctacgtttccgttcagttatgccaaaagaggagctgcgggaggaacttgacaatctgctgatagaaaaacaaatctttccaaccgcagaccatgtggaaataaaaagggaggattttattactcaggacgagatagaccataatcttggcaggggaagtggatattcacatggttctttccgcatctatgattattttcaggaaaagcatgacagcaaagaagcagcggaatttctgaaaaaagaatatggcattggaggcggctctcatgcacttgccggagcagaccatagctggcaagaccacaactttaaagggattgaattaaaaaagggaaatatctgcgaaccttatgcgaaagtgctgctgtcttggaaagtagtcgaaaagcgtatccgaaagctggtggcggaagataagtatttatctccggcagggaaagaagcctatgcccggtacaaagaggaagaagcacagaaagcgctggaaaaagcacaggcggtaatagaacggaaaacgaaggttgcctgtaaagaagccattgaacggacgatttcggaaaaatttgacgggtatcgtctgccgaaagatacaccggatgaagtaatccgaaaatatggtagcgagcgtgtcagctatgtacttgccaatactgtcatgcacctgacgcacgatggcagattttctcccgacaataaggcatgggcaaaagaaatagaaccgtatgccaagtatgagaaccgtgatttgattgtttcttcccatccggcggtcttaaatggatttatcaatcagacaagacggtatatggagcaggaaaaggagattgcggcacagcagattaccattgacgggcagttgtgtttaaagattgatgaatggaagtcggaagaaaataactatgtgcttggaaattccatgcaggacaatgcgttcttttacgtactcataaacgaaaatgtccattttgaatatgattacaaaccgagcagggaagaaattgaaaacgattatttgaatctcattgcaatggaagatatagaccgacacgaagcggaggtattttcacgcattgaaggaacggaagatgtagcggaaacagaatcacgattctcagttgaggaaaccagcgatgcctttgagccgggacaggattttgcagtatgggatcatggcagggaagattattatataaaagaggacggtacaattcccacctttgaaacaaaagaggaagcggaacactatctgcaaagcatggaaccggacacttctggacacgatgtccaaaagtcagtggaagaacctgccatagaaaagcctgtgaagcagcctgcaccaaagattgataaatccaatgcggtcaatttccacattacagacgatgcgttaggagcaggcagtgcgaaagagaaattccgacgaaatatagaagcaatccgtactttggaaaaggtggagagcgagaaccgtatcgccacacggtcggaacagcagattttatcacagtatgttggctggggcgggcttgccgatgcctttgatgaaagcaaatctgcatgggcgggagaatatcagcagttaaaggaattgttatcgtcgcaggagtacgcttctgcaagggaaagcaccttaaatgcccactataccagtcctgccattatccgcagtatttatgataccttagaccgtatgggatttgaaaaggggaatgtattagagcctgcaatgggtatcggaaatttcttcggaatgctgccggagaagatgcaggaaagccgactttatggtgtggagctggatggtattacgggcaggattgcaagacagctctatccgaaagcggatattaaaatatccggttttgaaaaaacagactatccgaatgatttttttgatgtagcagtcggcaacgtgccattcggacagtataaggtagcggataaacaatatgataaaaataatttcctgattcatgattatttctttgcaaagacattagataaagtccgtcccggcggtgtggttgcttttgttaccagtaagggaacaatggataaaaaaagtccggaggtcagaaagtatctggctcagcgagcggagcttatgggggcggtcagacttccgaatacagcatttaaggaaaatgcagggacagaagtcacttcggatattttgttttttaagaagcgtgaccgtgtgatggacatagaaccggattgggtacatttatcagaagatgcaaacggtatcgccatgaatacctactttgcggaacacccggaaatgattgttgggaagatggaaatggtcagcggtccctatggcatggaaagcacctgccaaccggatgccacaagaccgtttgcagagcagttaatggatgcggtcagccggattgacggggaaatcgaagcagtggagacggacgagcttgcggatgagctggcagatgccaccattccggcagacccggacgtaaagaattacagctacacactggtggaagataaggtatattaccgtgaaaattccattatgaagcctgtggatatgtcagaatccatgcaggaacgcataaaaggcatggtaggaatccgaaactgtacgcaagagcttatcaatttgcagttggaagaatatccggatactgtgattaaggaaaagcagaaagaattgaataccctttatgatacgttcagcagaaaatacggtttaatcaattcccagaccaacaaaagagcctttaatcaggacagcagctattgtctgttatgttctctggaaaagctggatgacgagggaaatttcaaaggcaaagcggatatgttcacgaaacgtaccattaagaaagcggaagtggttacaagcgtggatacagcaacggaagctctggcagtatctttatcagaaaaagcaaaagttgacctttcttatatggcggagctgaccggaaaagagattgatacaatcaaagaagaactgacgggcattatctttcagaatccggtcacagacaggtgggaagcagcggacgagtatttaagcggcaatgtccgggataagttgcaaacagcgaagatttacgccgaaaaccacccggaatacaacataaatgtgcaggcacttacacaggtgcagcccacagaactggatgccagcgagattgaggtgcgtatcggtgccacatgggttgaaccgaaatatattgaagatttcatgcgtgatgtttttgaaacaccgcagcatctcttcaaccggaatacaatggggattcagtattccgatgtgacaggacagtggaatgtaaaaggaaaaagtgcggattacggaaacagtcttgtaaatatgacttatggtacaaaccggagaaatgcttatcagattttagaggattctctgaatttaaaggacagccgggtgtacgataccgtgatagaggacggaaaggaaacgagagtcctgaataaaaaggaaaccatgattgccagtcagaaacaggaggcagtccgggaagcctttaagaactgggtatttgaagatcaggaacgtagacaggacttggtggcgaaatataacaagctctttaattctaccagaccaagagaatatgacggttcccatttgaaattccctggcatgacaccggacatcgaccttagaccgcaccagttaaatgcggtggcacaccagctttacggggacaataccctgcttgctcattgtgtgggagcaggaaagacttttgaaatgattgctgcagcaatggaaagcaagcggttagggttatgccaaaagagcctgttcgttgttcccaatcatttgacggaacagtgggcgagtgactttttgcggttatatcccggagcaaatattttagcggcaacgaagaaagattttgagccagccaaccggaagaaattctgttccagaatcgccaccggagattatgatgctgtcattatcgggcatagccagtttgaaaaaatcccgttgtcgcaggaaagacagataggcattatcgaaagacagattgatgagattgagcttgccatagagcaggcgaaagcagataacggggagcgttacaccattaagcagatggaaaagtccagaaaatcccttatgacaagactggaaaaactcaacgatacttcccggaaagataatgttgtaacctttgagcagttaggtgtggacaggctgtttgtagatgaaagtcacaattataagaacctttttctatacacgaaaatgcggaatgtggcgggcattgcacagacggaagcacagaagtcctccgatatgtttgctaagtgccagtaccttgatgagctgactggcggaaagggcattacgtttgctacgggtacgccgatcagcaacagtatgacggagctttacaccaatatgcggtatcttcagtatggtacgcttcagaagatgggattagggcattttgacagttgggcagcttcttttggagaaacacagaccgccattgagctggcaccggagggaacaggataccgggcaaagacaagatttgcaaaattcttcaatctgccggagctgattgcacttttcaaggagagtgcggatatccagacaccggatatgttaaagctgcctgtgccggaagcagaatatgagaacgtggtgctgaaacccagcgaatatcagaaagagatggtaacatcgctggcagatcgggcggaggcagtgcgtaacagactggtagagccgcatcaggataatatgctcaagattaccaacgatggaagaaaactggcactcgaccagcgtctgatcaacgatatgctccccgatgaggaacattccaaagcaaaaacctgtgtggataaggcatttgagatttgggaagataccaaaggggagaaatcagcacagcttattttctgtgatttatcgacaccgaaaggagatggtacatttaatgtctatgaggatataagaaataaactgatggaaaaaggtgttcccgcagaagaaatcgcctttatacatcaggcaaatacggagcttaggaaagcggagctgttcagtaaggtaagaagcggacaggttcgttttttattgggttctactgcaaaaatgggagccgggacaaacgtgcaggacagactgattgctctgcaccacctcgatgtaccgtggcgtccgtctgatattgaacagcaggaggggcgtattttgcggcagggcaacaggaatccaaaggttaagattttccggtatgtgacagagggaacatttgacagctactcatgggtgcgacacgaagtcgcttaatttaactgtttggcggtaattccgaccaaaccatccattccgttggatgaagccaatatccccggctttgccagtaatggcattgttcggaagcggatataaatggaaccctatttggagcaaatcccgtgagggagaagcaaaactgccagctacaaggcggttagggtgcaggctttctgatagcatggttaattaactgaatcaccgtaagcttcgttaaggctgaacaagccaaagtagctgacaggcttgaaccaaaaggtgtgcagttggatattcctctccacgataggaatacacggacataagactgccggagtagaggtggaacctaaactatcaatgattgttgattaagtggaacgtgtcaagcccgtattctcgcctgcaaaggcaagtggaccgtaagggaagccgttgggaatgcgggtaaaggattgcggaggaagcgaatgccgaccttgtaatgaggacggataggggttcaaaatttgccccacccgaaaggggagcagaattccgcatggtgcttaattacgagagagtttatagaatttttgaaaggagtaaggcaaatgaacatgaaaatgtgtgcgacttctgacgttgcaaaggcatgggacagcatcgactggaacaaagcgaatgcatacgttaaaaaactgcaaatgcgtatcgtaaaggctcatcaacagggcagaaccggcaaagtaaagtctttgcaatggctgcttacacactctttctacggacgtgctttagctgtaaaaagagtaacgagtaataaaggcaaaaagacagcaggtgtagacaaaatcttatggtctactcccaaactgaaatatgaagcaattctcagcttaaaacgcagaggctataaaccattaccgttaaagagggtatatatcccgaaaaagaacggaaaaatgaggccgctcagtatcccatgtatgaaggatagagcgatgcagacattgtacaaatttgcactggaaccgattgcggaaatcactgctgaccctaactcctatggatttagagcaaagagatgtgtacaggatgcaatcgaacagtgctttacctgtctgaataaagcaaaatcccctaaatgggtgctggaaggagacattaagggctgttttgataacatcagtcacgaatggatactgaaccatatcccaatggacagagatattctgcgaaaatggttaaaaagcgggtatgtcgagaccggaagattatttccaacagacctcggcagcccacagggttcggctatctcaccaactatctgcaacatggtgttggatggtctggaagtccagattaggaagaaataccacaaaactaaaagggatggaaaagcatattttccaaaagtgaactttatacgttatgctgacgatttcatcgtcacaggcgaaagcagagagcttttggaagcaggtgttctcccgattatccgggaatttttatcagagagaggattggaactgtcagaagaaaagacagtgattacccatatcgaagatggttttgattttctcggatgtaatatacggtggtataaagacaagcttcttacaaaaccatccaaaaagaactataaagccattgtgaataagatacgggggattataaagcaaaatccatctatgaagcaggaagatttgataagaaagttaaatccggtcatcagaggatgggtaaatttccaaaagtataatgtctcctcgcaggcgtttgacaggtttgatttcgatgtatggagatgtctgtggagatggtgtaaacgtaggcatccgaagaaaagccacaaatggatagcaaagaaatatttcaggagagtcggcacaaggaactggacattcagtgtaaatatggcagactcatttgaattacatctgatatatgctactgatactaaaatagtaaggtggctgaaaacaaaatcagaagcgacaccatttgatgagcgtttcacagaatattttgaggacagaaacacaaagagaatgcttcgagaaatcaatggaaggaaaaaattaaatgcactgtacaaaatgcagaaaggcatttgtccgcattgtggtgaacctatcacagtggaacggggattccgaatccatacggaagtgggagcagattttaaagaaacgaatgtcttattacatgctgattgccacagagaacttcattactcgaaaaatgttgatgaactggttctgctaacgcagggcttataagtgcttgagccgtgtgaggggaaactctcacgcacggttcttagaggggaaagcggtagtaataccgctgacctactcgaccagcttatcgagaataagcagaaatttatcggtcagattatgacaagcaaatctccggtgcgaagttgtgaggatgtggacgaagcagcactttcttatgcagaggttaaggctctggcaacggggaatccctatataaaagaaaagatggatttggatattcaggtcagcaagctgaaactgatgaaagccaaccacaccagtcagaaataccgtctggaggacaacattgcaaagcattatccacagcagataaccattctgaaggagcgtatcagtggcttgcaggcagatattcagactgcaaaaaccaatctcccagcagataaggagtttttctctatgagggtcgggaataaggtctatacggataaaaaagaagccggaactgcacttgtggagatgtgcaaagaaatcaagagcgttaatgctccggcagtcattggagagtatgcaggctttaaaatggcggtgtcctttgattcctttaaccataaattcgttatgaacatcaaaggacagctcagtcataatctggagattggtgttgacccgctgggtaacatttcccgtatcaaccatgcgttggaagccatgacaaaggaactggcagaagcatccacaaagctggagaatgtggagcgtcagcttgaaacagcgaaggtagaggttacaaagccatttgcacaggaagcagagctttcagagaagttagaccgcctttctgccttaaatgccctgctcaatatggacgaaaagggagatgacggaataggtatggaagatgataaatcggaactgggtactgagcaggtggcagataccagaaaaccgtatcccatagaaaatacccgacataattatgctgtggagaatggaaatccgcagggaatgaggctcacagcagcgatggcggataagccggcacagagggtatccttgaaagaaaagcttgagactatgaaagtaaaggctgcggggaataatatagaaaattccgtgcaaagagataaggggaaggaggagtatttgtaattattatatttctttttatgcaaatatgaaatataatattagttcaagggaaatatagtgatagagcgatttggaaaaagctaaagagaaatggagacaacgtaatacataaaaatggaaattgaatttgtcagacactgtctgacaaattcggaaaggatatattatgaatgatttagagcagacaaatatgcttcagccattggtggatgagattgaaacagcagtttcaaatgccaaaaaagagatagctgaaaaagtaaacagtgtaattacagagacgtattggaaaatcggaaaatatattgttgagtttgagcaggatggaaatgttaaagcagcatacggttcaaaattattaacaacactctcgcatcaattaactttgcgattgggacgaggatacagccgcccaaacctcaacaatatgcggaagttttatctttgttatgagaattgtcagacggtgtctgacaaattgacatggtcgcatatttgtgagctgataaagattgatgatgaattagaaagaagtttttacgaaaaagaatgttataaggaaaagtgggatgtaagaacactcaggcgacagatggattccgctttgtttcttagattagctacaagcagagataaagaaggaattctggcacttgccagagagggaattacttatgacaagccagaggatgttatcaaggatacttacacattagaatttttgggacttccggagaaagagcgttatagtgaggaagacttggagcagaaaataatagataatctccaaaaattcttgttggaattaggaaaaggatttacctttgtgggcaggcagtatcccttaactgtaaacaatattcattaccatgtggacttggtattttaccacagaattttgaaatgctttgtgctgattgatttaaagaaaaattccgtccagcatatagacatcggtcagatgaatatgtatatggggtatttcgcaaaagaagaaaatatggcagatgataacccaccgattggcattatcctgagtcataacaaagatgaactgcttgtagaatatgcaacttacggtatggacagcaatttatttgtttcaaaatatgaattgtatctgccaaatcgcaatgaactccaaaaattagtgaacaatattttagagaaggatacagaaaagaaagaagagtaataaaaaagcaatctaaaaaagatgcaaattgaataggcatatcgaaaaagacaatcagagatggttgtcttttttgcgtggaaaaaagaaaggacaatcgaattatggaagataaaaataccgtttacatgagtgaaaagcaaaaagtcaaagagattacggataagctggaagctggtttgaaagagctttttgagagtgaaaaatataaaagctatctcagtaccatgtcaaaatttcataattacagttttaataatacgctgctgattgccatgcagaagccggaagctacgctggtggcaggttatcaggcgtggcagaagaactttgagcggcacgtcaataaaggagaaaaggcaatccgtattcttgcaccagctccttataaaatcaaagaggaacgtgataagttagaccctgtaacgggagaaatgatgtttgatgaaaacggtatgccgcagaaagaggaaacagaggttaccattcctgcctttcgtgcggtatctgtttttgatgtatcgcagacggatggcaagcctattccggaactggaagtgaatgagctgttatctacggtggagggatatgaggattttgtccaggcgcttatgaatatttctcctgttccgattgcatttgaagatattcccggcgattccaaagggtatttcagtacagcagaaaaacggattgctgttcaggaaaatatgagcgaaagccagactttgaaaacaatggtgcatgaggtggctcattccaggctgcatgataaagaagttaatcagagcatggatattccggtaaaggacaggaatacaaaggaagtggaagcggagagtgtggcttttacagtgtgccagcatttcggtatagatacatccgattattcctttggatatatcgcaggctggagcagcggcaggaatatgaaagagctgaaatcttcccttgatacaatccgaaagacagcttcagaactgattacaggcattgagggggcaatgcaggagcttcagcttaaccgggagatggagcaggaacatggaaaggaaagcattctgctggtacataacgaggatttttcagaatacaatcttgtcagtgtccgtggaatggacagtgcagaacttatatccgctctttctaccatgaatgaagaggataaatcgaatatatcatcttatcttgaaagcaaaggagcatggactaccgaacttgctgacgagcagacggaagaagcggaggaatatcatattgatgtccgctataacatggatacagacgagcttattgatgtaaaggaaagaatggaacaccccattgataccaatttatctgtcatggggcaggcagaacaacttatcaatcagttggaagcagaaaaaaatattttcacgtctgaggagcgaaatctgattgtaaattatgcctataaacttgatgatatgaataaaacaagggaacttgcagagaaactggcatatagggagcagtatgcccaacaggatgtggcattgaccataattgatgcaaaggcggagattgatgccctgcctgatccgatgattggtttgtcggaaatgagggaatatggctatcaatggaatgaaatgctgccattaacacaagagaaagcattggaattatttgaacatgatttgcctgtatatttgcttcatactgacggtgcggaatcattggcagaaagcagggagcgtatagaagagcatgaaggtatctttggggttgaaaaggaaacatggaataaagcattgaaacagcagactaagattacacttatcttaatggacgaacaggagcgagaatatacatacccgtatccagttgtggctgtcgatatagaagaaatgggtggggatagaactgcggtattcaagacctcagagcctatttcagatactgatgtggcagaaattcataatgctttttatggaactgatttggaatttgaaatagaaaaagaattaggtatcacatgggtggaatctattaactatgaggacggatctgttattacacctgaaatggcaagaaaagagcagctcctatatgctagtactgataaatatggaatttatcaattaaagcctaatccggaattagattccttacgttttgaggggacggaatccttaaagcgtatgggcattacaaaagataattttgatgcaattaaaccagagaattatacacttttatatgtgggcgaattatctgaactgcaaaaagagacgcagggggcaactttagaggcaatctttgaaaaattcaaccttgaccacccagaagatttcagaggacattcgctatctgtcagcgatatagtggtgcttcatcagaacggacagaatacggctcattttgtggattcttttggatatacggaaataccggattttttacgggagcagacaccggaaaaggaagaaatgcaggacacttctggacacaatgtccaaaagacagaaccggaaatagatggagatgaaatcattgatcttggcgatgaaacagaacaggtgcttgcggaaatgaaaaaaactttggaaagtgaacaggaaacagaactggcattttctattgcagaccgttttatcagcattcaggaagtggatggcggttatgattattccattatgggagctgattataaggagattgacggaggaatttatgataatcctgatgtgacgataagggaagccttgcatgatattttagaggatttgaagtcacagccggattacaatggtgcaaaaggaaatatccaaagagaagatgaactgataccgatggattatgatggactgatggaaaaagcagaggaagcaaatcgtattattccggagagtacaccaagcagtgtggtggcagattttaaggcaaagaccggggaattattccacgatattagtgaaatgaatccggaagaaatcgaggaaactgtgaaatgccatgtgcaggcgaagattgaagagtatgatattaatgcaacaatcgtggatgttgctgtaacaggaagcagatgcaggggattagagcatgaaggttctgaccttgatgtggtggtggaactttccacagcggaacgggaggacgatttatttaatgcctttaatgaggatggacttcatatcggagaagtaaaagttgacatcaatccaattacagcccaacgaacaggtacgctggaatcctatctgccacagatggaagaatatttggagggcgtcagacaggtaagagagcaggaaaaggagagcgcagaagtaactttaactgtttcggaatgtggagaatttcataatcttggtgagtgttatgagaatattcctacggtggatgaagctatagcaatctggaagcagataccttcagagcggatgaatggtattccggcaatcggaatcaatatcctagggagaggggcggaacccttcgaggattacgagattgatgttttatctggaaagaggattgaccttggggttttggactatgttcctgatattaaaaacaatccgcaggcaatggaagtcattacggaactggtggctaaattgcccgatatggagatagatggcgtgatgagtgaagaaatggaagcaagagtgtgggaactgcgtatgccggacttgccacaagaggaacagcttgcagtagaacttgaccgactttcctacgattatgatactgtactgtatcacgatagtacaagaaatatgaccgagaatgtatcagagcttgcagaatccataaaacagggcgataccggacatttaacaacgtggcttgcagacattatttcggagggagctgtaccagaggaaataaaacgagcaacggagcttctggaaaaactgacagagtataagccgcttgccaagattgaggaggcagaagaacagaattataatatgattgataatgtgctgaataatggtgttggggagaaagcccaaagggaagaaaataagagaatggaggagaagcctacggtaaggctttccttaaaatcccgtcttgcggagaaaaaatcacaggtagaagggcaatcgaaagaacatgatgttcaagaaaatgaaaagaaaagtcagagggagatgtaagtgatgaataagagatttaccgtagaagagagtaatttaatcagtatttttatggaagaaggtatagattcagatgtgggaggcagaaaaaatgtcataaatggtatcaataagacactgaaacatctggaggatgatgagatggttgaattgtcattatgtgtccttgcaaaattaaaggaattgacggatcatgaatttatgaagatggagtttgtagcggcagagtaacatcaaacgtaaggcagaacatggcttttggtggctgtgttctgtctttttgaataagaacttgactgataaatattacgggtgtaatatttataacgaaagggagtaaatttttttgcttcaaaatcttacacttgtaatatataagcgtagtacattgatacgaataagaaatggaggtaacgatgaaggcaaaacatagaaccaaaagaatacaaagatatagaaaaatgttgggcattatagtgttaatgttaacaattactttgattggagtagttgtgagtgcaacagtattatataaaagaaaaaatgcgtgtaaaacaccagatactatcttagtagagtatatgatgcatattccaaaacaagaatacgaagaaatgtatgcaatgattgatttggagtcatctggatatatcagtaaggaagattttctgaagagaaattccactatttatgagggaattgaaatgcaaaacatgtcgataaaaaatgtcgagtatgtggaggaagataaaaaagtaacatatttgacttcgtttgatacagtggcaggaactatcagctttgagaatgaggcattttttataaatggagaagaaggatataaattggtttgggatgattccatgatttttcctaatctgacttctgcagataaagtaagagtttctactacacaggcagagcgaggagaaattctggataggaacggacgtgtccttgcaggaaaaggtacagcatcttcagttggaattgttccgggcaagttggaaaacagagaggaagcaatcgcacagattgcaggactattggaaatcacaacggaagcgatagaaaagaacctgtctgcaaagtgggtaaaggatgattcttttgtacctattaaaacgattccaagagtggaagaaattgagttaatgtctatcagtccagaggaagaagttttaaaggagaaagaaaggcatgataagttgctggagattcccggagtgatgatatctgatgttgaagtgcgtgaatacccattaggggaagccgctgcgcatttggtcgggtatgttcaaagcgttactgcggaagatttagaggaacatgcaggagaaggttatacagccaatagtgtaatcggcagaagcggaatggagggcttgttcgagaaagaactgaaaggccagaacggttgcaggatttacattgtaaattcggaagataaagagaaggaggaactggcttgtatcctggtacagcatgggcaggacatccggcttacgatagatactgatttgcaggtttccttgtacgaacagtttaaggaagataaaagctgctcggtagccataaatcattataccggagaggtattggctttggtcagcacaccggcttatgacaataacgattttattatgggattatcgagtgagcagtggactgtacttaacgaggacgagaataagccaatgtataatcggttccggcaagtgtggtgtccgggatctaccttcaaaccaattatagctgcgattggtttacaatcaggagcaatcgatccaatggaagattacgggaacgtaggattaagttggcaaaaagatgcatcgtggggttcatatcatgtaacaacgcttcatgcgtatgaaccagtcattttagagaatgccttgatttattctgataatatttatttcgcaaaagcagcattaaagattggatcggatgagttggagaattctttgatacggcttggtttcaatgaggaactaccatttgagattaagatggcagaatctcagtattccaatacagaaggcattgaaactgaaatacagttagctgacagcggttacggacaaggacagattttagtgaacccgttgcatatggcatgtatttattctgctttctgtaatgagggaaatgtaataaagccttatttggtatatcagaatgaagcggaagttgagtattggattccgggtgccttttctaacgagacagcaagtcgtgtattggaaggaacaaagaaggttgtgaatgattctaatggaactggatatgcagcccatcgagatgacattcttttagcaggaaaaacaggtacggcagaaataaaggcatcgaaggatgatacttcgggtacagaattaggatggtttgcaatttttacagcagaagatacggaatgtcctatattgattatcagtatggtagaagatgtgaaaggaagaggaggaagcggatatgttgttaagaaagacagtctggttctggaagagtggtttagcagtcattagttttgtactgatgtttagtatttcggggtgtagcgatacaccaccggaagaagatacagtttcggaaacagtaattgatgttcaggacgtttcagaagaagaacaggagaatgaagaagaaattataaacatctgcatagatctttatgacaaggcagcagaggaaaataagttagatgatttggaaataattcggagtattgtaaatcgtcttggagaaaacgagtatcctgctgttgacagcagaaatcaagtgaatatgacggaagcggagcaggtactggaattttgtgaaaaggtggatgcacaggaagaagcagatataacgattcttgaagtcggctatttgggcggatttgtaaaatacgatttgcacacaaaagacggaaatgtagatgtggtcagaagctattatggatacgaaaatggagaaatacagaaagaagttactgggaggtatcaagcagagtattggaattatacagaagaaggttacctgatgttttctggtgtctggttttcagaagaattatacgttcttacattgagtggagcagaggagcataccgcattacgagtacagccattggatgaaacatatagggaactgagtcggaaatatcttcttccaatcagctttgaacagaataatatgtttattgtggattggagtgaagaagattttggggatttgaatttctatgatatgtatgacattctttatccaaaagtgaatggtcagtatgttccttatgttgcagatgacaatttgtcagtcagtgcagtttatcggattccaaaagaggaatttgaaagcgttattatgaaatatttcaatattgatagtgaaacgctgcaatccaaaactgtctatgattcggaggattcgacctatgaatacaaaccgagaggcttcgaagaagtagagtatccggaatacccatattcagaagtaatcgggtatacggagaacagtgatggaacaattacacttactgctaatgtggtatttccatattcgggaaattccaaagtatatgcccacgaggttgtggttcgtcctttggaggatggcggggtacaatatgtatccaatcgaattataccctccgaggataattctgaggaaacatggcatacgccacggttgacgttagaagaatgggaagaattatacggaggcgaataatggaagatgtgaaatggctgcttagaagatgtggtcttccgattttgctgctgttgattttcgtaatagccggagtggtctgttggggagaactgcatacagaaaagcaaaaggtggcagaagaagtatgggagccacctgtagaaatcgaaaatagcgaagcagaaacagaagaagccgagaatgcggaaacttccacagagtcagcatattggtttattccgcaagccagtgatgatctccttacagaagaggagaaggagcaactgcagagtacggttttgtcagcagcagaatcggtcagagaaatctataaggatattgtaattgcagatgcaccaagctactcttccggtattggcgaatttaccaaagagcagaggaaagctgtggtggagcaattgggcagaaccggtctggtaagtgttgaagaagatactgctatgcaaaatcatgaagcaatcgaagcattttatgcagattacctggatggacaagactcgatggttacggtatttgaagtacagagagatgggctgattggagcagttacctttatctatcggaaaggtgagttgcagacctattacataggaattcggtggagagaaggtggtatgccagaaatacagggaacttcggtaagtaatgtggctgagattaaactgaccgaaaaaggatattttatctacgcatatgaatatgtgattgcacatgcaagtttgagacagtattggagaatagaaccgctaccagaagactgccgggaattaacgcaagaatacatatcaggactaagttatgtgaattacaatctgctcgttaccgattgggatagcagcaatgtggaggacattctgatgccttgtatgtatgaagatgtttataggatttctacgggggaaaatctgaaaactgagggttggaagattccggcagaggaatatgaaaggataatgactacttattttccggtatcggtagaacagttgagagagcattgtggatatgatgagggcagcaatagctatgaatatgagatgatttatgccagtccatacccacctttcggagaagtagttgactatacccaaaatgcggatggaacgattacacttatcgtggatggagtatggccggattataattctgatctcgcttttcggaatacggttgtggtccagccatttgaagacggaactttcaggtatctttccaattctatagaacaaatagagttggaactgccgccaatagcaaaagcacattaaatttgctttgaaagaaaggatgatattatggcattaaagaaaaaaagcattttgctgattatggcatttctgattggatgcttcgtatgtgcctgtggaaaagaagatagtattgtggatgaatctcttgtggaagatacggaagatgtatcttccacggaggagataaaaagtgccgaggaagaggctgcagaacaatgggaaaagggctacgaccttccgttagatgaacaggaaagggaagaagctgagactgactgtaaaaagcagatggaactttatcttgacatttatgaaactgcagataaagggatagcatctaatgttgctttggatgatcaaacagttttggaaatgcagaggaagctaaaggatgcaggatgtccggttacaacaatggtaacatattctaacatggagaattatgaaagtgttgacagttttctgaaagaatgtatggaagggaaaagtggttctgcagtaatttatgaagtccacaacgatggtggattgggcagaatgaaattcatttttgatggaacagatatgtatgttgtaagtgcaaaaggaatctggaatgctgataataagccggggatttcatacatttcctatacaagactaaaagagtggaaatatacagataagggatggttctgctacgagttgtgtgtgccggagccaccggaggtcagtgaaattgtggatggaagcagcgtgattagaataaaacctatgacagaggaacagcgagagatgtctgagcgcctcgtcttgggacttggatatcagggacagaaccttttgtgttccaactggaatacggaaaatatgagtgaattggattataacggaatgtttgaatatctgtatggaatgaaatatggagaaaagttcaattccgaagattatccaaatggtattccaaaagaagaattcgaaagtctgattatggaatatcttccgataacagcggagcagatacgagagtacgcagtatttgacgaggaaaaccacacatatgattgggctcgattaggatgtggaaattatgcacctactttctttggaacttctttgccagaggtcacggatatcaaagaaaatgatgatgagacagtcacgttaacggtggaggcggtttgtgatatggttatttgcgatgatgcagtcataacccatgaacttacggtaaggtttgcagaggatggcagttttcagtatttggggaataaaatcctaaatgacggaattatgcagatacccgattatcaataccgaattaaagaatgatttgataatagttgtgttttgtggtaatcttacagatgtaagaaaaggaaggaggacacatgaagaaattaaaactagttggaatattggcagcagttgtattaataggcggtgtgatttcaattccgcttataaataaccacactgcttataaagtggaaaagaaattatgtgaaacaccactgccagagaaaacggaattgatagagtcaatatcacgggcagggaagctgacaggtaacggaaatggaatgcagtatttcggagcaattctaattcgaagtgacttgtctttggaagaattggatgcttactattcaaggtacagaagtaatgagtgggaatgtttggtgaaaattcaggaagggcagtccattgaggggattgatcacgggacactacaatttgcggaagaaataaaggacaggggttattacattgtatattcttggggaagtgaaaattctctattggatgaattggatatacgtggacactaaaaacgagatggagacaaattatgaagaaaatttctaatatatgtggttttattggaattgctatatatgcggtgctgatgattcgcatttcaaatctatgtcaatacggtgggacgaaagtggacttgattccaatattgattttgggtgttgttcttatagcaacaatcatttttggaattgttagcagtagaaaagaagaaaaaattgaaaaaggtaaactgttctggggaaaatgtattgtagttgttgccctgaccattttgtttggaggcaggattatttattcggcaatcccttataatggtgcattgtcatggaagattgacgaatggcgtaaccaaaagaaaattgaacttactcataccaacttctttgagacaggtgtagaaggaatcttggaagacattgagacagagttggatttaccggatgaactttatgttcaaaataagttccagctttcctttgacaaagatggtgaaattcagagtatttatacttatatgtatggaagatatgaaaatggagacgaaaatacattccttattgactatgatgtggatgcagattcaaaaatgactgtgtgtattaatggagttgcgagcaaatcttacgatgatgacatgagattacagccgatgcttgaaattttgaaaaacgctgattacaaaacaagagtaaataactgggctgtggaaggatatgcagacgattatgaaattctctattatggcaagcgggaatttaacacaatggaaggatttgtatatcttcaaggtgatgtggatggtgacggagtggacaacacagacaatgccatttattcggaactgaatggtggagctgtttatggatatgaagtctcgcttcatattccaagtgaatctgaggtgactccggtacgttattttatggaaccggaagtgattccgttagaaactatcatcgacagggaggaagagcagactattgatgatgctaaagaaacagaatcctggtatgtagataattccaacggttctgtatattactggttgtctgagaataaagaaattggatggagattagtagttactgatgcggcagcaggaagccgttattatgaattggaaaagtcatcagatggtggtgaaacatggaatgtgataaatgccaatccgtttaacaacaagattggcgtggcactgggaatagaattttacgatgaaaatcttggtgtgattggtatgacaggcgcttcacaggatgcctcaactttatatgtgacatcagatggcggagttacttttacacagatggaatttccaatggaagaggttacggaactgccggatattgctgatgaactaggatacacaatcgcagattatgattacgcagagatgccacaagtatccgatggacaatggactgtaatcatcaaggcagaatacagcagttacggaggcttgagatttacatctaacgacaatggaaagacatggatgtatgagggattaagtacaggcgaaggtgatttacaataagaaataaaagatacgaatagtgttaaaacacaaaaaatcgggtaaaagattgtacgactgactatgacctttacccgattttattatgttttatttccagatattcatgtctgacaagatagacatggttatttcagttgcgttgcctccggtagcatcgctgtctgcactaatgttggtggcaaaaaagtatgtattatctgcagtttcgatataaccgatgaaccatccgtttacatcctgtccattaacacggccagttccggtttttccgtagaatgttccggcatcggaagctgaaaggcagatggcatcttttactgcattgatattttcaggggcgaagccgaaactgttattctgcagcttggttaaaagttcgacctgttctattggagagatttccaaggaggattccatccaataagaggagaaatcgccactcatgttttcgttaccatatccgatttcttgaacatagctgtaaacgtcagaggttccaagctgttcgtctactgcttgaaaataccaattcacagaggagttcattgcagactgtaaggtctgatctgcgttccatgcttcaaatggataggtttctccattccatgcaatgaacgaattttctggtgtaatgacgccttcttccaatccgaacaaagcatcgtatatcttgtaggtggagtttggagcaacccgtaaggtggcatgctccatgtcatgtatactccatgcatcgttttccaaatcgtataaaacaaagctgccttcgtattctctgaagtatgtggagaggtctacataggaaatattctcagaagaggaatcccattggtagtggcttccatctgctgcgtatgtagaaataaaaggtgcgaatccaaggagaaggacagcagtcaacatgaatgcagtcataccttttactctttttataaatgtcggcttctcataagatgcaatgttgataattctccgtttcatctgcttcatgtttccaccaagaccggcggcaaacggaaatggagtaagtgaaatcttttccgcaaaattgatcagtgtattaccataatctgcataatcatcctcctcaagcatctttaaaacagaggtgtcacaggcaacctctctgtcattacgcatttctttcagagcataccagacaagaggattgaaccaatatattactccggcaaagttcattagatagttggcaatagcatctttgtgcttatagtgctgtagctcgtgtaacagcatgtatcgcatgtccgattcgttataatctgagatgagatgaatcggcagataaatacaaggtttcaaaagccccacaataatcggagatttcaaaaatgcagtactgtaaacatggatatttctgttaattcccatttctttcatacatcgatgatatagttttcggacttccgggttctgaaggggaagtgcagattttttcaagttctgtaagcggatagaggacttgattaccaatataatcattgcaaggatgcctacaagccatattccaaatagtatgtatccgatgctggatggagtctcactatttaccgaaagggcaaagtcattcatccagtctgcatttccggctggattgatcccaacagcttctcctatggcggttctggtgccagaagtaggagaacttttcaggctactgagccacgagaggatttgcggaaacccaattaaacggaacggtataaaaggaactaccaacaatccaagtagcaggaaccatagattatactgcatccggctggataggttgactttgaatatccgcttggctatcaaaagaattccgatgataccgctgataaatacattgcatattaaaaagcgtatcataaaatcagccatgttaattacctcctttttttgacctcttggaaagaagagagcggagagtgtctatttccgtttcggacagtctgtcattttctatatatgcagacagcatggcagtgatgtctccatcgtagtatcgttctagaaaagagttactttcctgaccgatgtattcactttctttcacaactggagtgtaaacaaacacccgactttgtttttcataagtcagaacgcccttgttcactagacgtttaattagagtttgtattgtttttggactccagttcgtagtctgtaataatttatcagttatttcattggtgctgatcggcgcatgtttccatacgattttcataacttcaaattcagcttcagaaatctgtggtaaatcgctcatttcaaatccctccttaaatcttacggctgtaataaaaatattatagatgttatttgtgtagttgtcaatttaagagaaaatagattgacttgaaatcttacttatgtaataattcaaatattacataagtaagaatttaaaaaaggagtggaatcaggatgattgaaattgtaaataaagtgctttgaaaataagaaaaccaatagagtcacaaggagtctattggcattcttacagagttggatggtcttgcttgtgcagcagatcaagcagataacgaaccataggcaataaatccgcagcctcctgttccgtgcagtcattcagcagggtcaggagtttttggagatttggctgttggtttgcgttggctgggtagaaaatcttatcggcgggtatcttcagatatgtaatcaaaggatacagcttatcatatttggggttaccacgtccggcttcaatatttagtatggtgcgggtatccatattaagagtttcagccagcttttcttgtgaaagtccgagttcggtacgggcttcacgcactgcaatggcaagaatttgttttatgtcatgcattataattcacctcgatagtagtttacaatacctattaaaacgagtgaattgcaatagaatacagtgtagatatggagtgtaatacatggatgtaaagtatgtgaaaatacatagaaaaagaatagtgaaaagttttgagatagcagcatattacacactaaggtgtatcgcaaagaagtataaaacttcaacgcgatacaccttttttgtggggaaatcagagcgttgtaaagtctttttccggtttgcggtttgtggtctgttcctgtcccggagtccggtcaagatactggttcagattatccagttttcggttgagagcctgtatgtctttttcagcagatttataggttttctgcaaggcttctttcttggcatacagagcattgtaatcattacgaaacttatcaatatcaaaatgttttaagctgattccaaagcgtttcagcatattttctgcaccgtcatggagcaggagttctgtttcatggtggcggagataagcgtcagggtctttcgatttccggtaacggatgtgatagatatgattgctctgatattgttcagcgtatttcaatatctgtcctaaatcctttagctgacgttctgtttccacaagactgttccgtgcggtttttgcaagaacagacttactttcaatctgtttttcaagctcgatgatagaacctgctttactgtaactgctggcagcgattttgagattttcaatcgctgcccaatgctgcagaccggggctttgcgtgaacttttcttccgaggtgtcaatgagcgttcgggaagaataatccttgataagaggtttttttcgggcagggaatgggacacgtttttgtgtctgtgctaaagcctttgtttctacccgttccttaatccgttctttggtgtattctgcacccaaagactttaagctgccacggacaaaatgctcccggtcaagggggcggaaggaaatgtactttaaggcgttttctccaatggtttcgcctttgatttcataaccttttgcccgtatcagctccatgcactgttcatatgtatcagcgttttgaattgcttcatcaatgtcctgcttgagcttgattttccacgaggtgccatttctgccggatgtccattctttataacttttaccacgctggtttgtgggagaaatgacggataactgatgcttggaacacagctcatcattcaggcggcgaatgtggtagtaggtctgtttacagtcatgatatttttcgtgattcacattatctgcggcacagaaaatgatgtggttgtgaacgtgacctttatcaatatgagtggaaacgatataagaaaatttcccctctaacagcttgtcggcaagctccacaccgatctgatgtgcttccttataagatacctctcccggagcgaaagcctgtatcagatgaaaggctttgttggggtctgcctgatttgtttttgacagagcaaatttgaagtcaaaggcagcggtttcaggactgcatccgaaggaagaaatgagactactttcatctgttttttgggaattacagatatagtttactgccttatggacggttgcctggatagcatggatttttgtgattgccatacctgtttcatcagctcctttacttcgtttacatcggctttatagacattgccagtagcattcatccgcttggcaatctggttcagattattgccgatacgggcgagcgtggtgttgtattcccgcaggtgttcgtagtttacatcgtagacatagccatacaaaatcagatgccgaataaatgcggatttgctcttcatgccggaggctttccatttctgatctaagatgtattgctcgtcatcgctgagatagattttaagttcattttgtctttctcggtttgccattgcagtatcagtcctttccttatttgtataaaagattttcaaatatgccgtagccggcggttgttttttgcttttagggggacagggggatatgccccatgcaagccaatttctgcaagttttcacttggtagaaatttgcggaaatggtgcctgtgagggaacacaggcagtgcttgctattcttctgcaaattacccgtagggaatttgcgtgttgcgtgagtataggcgagcggtttgcaacacagtagggcgttaccgcccttgttatggatagcgttgataattcgactttgcagttgggcagaagcaataaaaaaactgccacggttcataagggcattgattgcccgtaaaaactccatagcagtttgtgtgactttttatgatttttgattctatccataatgattttatcaatgggaaaggggaaagtcaatggctggagagagataaaagatttacagagaaatttaggggaataagcaaagatactgcatattctgcatttaaaattagaattggaaaaccagaagagagggggtgaagcatgaataccgtacatcgtagaacggaaataatcaatattcttattatcagacgacatacaacagcgaatgaattggcacaggaatttggcgtttccattcgcacgatacagtatgatattcaggctttaactccggtttatccgatttatacaaaacagggagagaacggaggaatttttataagagaggattacaagccttatgccaattcgctgacacctatggaagtagctgccttgcatgaattatatgattggacggagggcatacataaaaaagttttatttcaagtcctaagaaaatatggaccggataaattacaactttgatcttgtcattctgataaagcacataatttttacagaaccgttcatagcagacggaagtgtgcttatgtgctttttaggctgacaatttcagctttgattttatccaaaatgcagacgatgtctgcgattgtaccttgacaatttcataaaccaatgcgtacaggacgtgtggaatatgtggagccgctttgaggatacgccataagacacctgcttttgcctttggcagaggtggatacgaaggaatattgaaagcagatattgaagttaaggtgtggagcgagaaatatccggcataaatgtgtagcagttacacggaggcgttgatacatatttttgataatgatacttccggcttagtccggtcagataagatgacggtgcgataccgatgtgggtagtgtaatgagctgctacctgtacggattttttaatatcttccaataaaagcatatttgtttgttaagtatgtttttattggcagatatgccataaccatagcaagagaaaaagaacacactttgaaaaggtaggtggaagaatgcaggcaaaagtgaacacaaaaaattttataaggtatgacgagggtgcggagaggtattctatgagtaaacacagctttatgaaattggcacaggatgctcgtgctgtttataaaattaaccgtatcacattggtaaacgtgaagatttttgaggagtatttggaatcttttcgggcgtagacatgataagaaagaggaaaacgaattattgtatatcaaaaagtatttgactttttgatatacaagtagtaaaatgaagtcaggttatgaaaggcaggtgttgacggatggcaagaatgggtagacctaagttagaaaatccgagaagtgaaggtgtattcatccgtcttacaaaagatgagcatacagatataacagagtatgccagctctcatgatctgaccataacacagacgcttgttcaaggatttagaaagctgcaagagcaggataataccgagaatgagtaatggcatttgtgacctctttcttatattgagaggaaggtggtacataatgtcaatgtcgagaaaagattcaaaaggcagagtattaaggaaaggcgaaagtcagaggaaaaacgacggaaggtatatctaccagtacaccgattcgacaggtaaaaggcgggtcgtttattcaaatgacctgttggagttaagggaaaaggaaaaagaacttgttcgcaatcagttggacggtcttgaaagctattgcagtggaaagacaactttgaactatgcatttgacaggtatatttcaacgaagtatgatttgaaagaacacacacgggtaaattataagtatatgtataaccgttttgtcagagatacttttggaaaaagaatcatcaatgatataaagtattctgatgtgaaattcttttattgttcgttgatgaacatattggggttacaggcgaatacattggataatattcatacgattctgcacccaacctttcagatggcagttagggacaatgtgatacgcaataatccggcaagcggtgtaatggcagaaatcaaaaaggcgaatggaaagaataagggcataagacacgcacttacattggaacagcagagagcatttttgaactatgtatcgaacagtcctgtgtattgccattggttgccactgtttacagcactttttggaacgggatgtcgcataggagaaatgatagggctgcgttgggaagatttggattatgagaataaaaccattagtataaaccatgcggctatctatcgagtaatggagaatggaaagagtgaatttcatatttcttcgccaaagacagaagccgggattcgtactattccgatgatgcaggctgtagaacaggcatttaaggatgaatacgaagcacagaaagaaaccggttttaatgtgcaagtggttgatggtatgagtgggtttatcttttgcaataaagacggaattatccataaacccagcgtaatcaacagtgcaatcaaaagaatttacgaagcctacaatgccgaagaaattattaaggcaaaacgggagagcagacgcccggtattgattcctcatttttcgtgtcatcatatccgacacacattttgcaccagattttgtgaaaatgaaagaaatctgaaagtgattcaaagtattatgggtcatgcaaatattgaaacaacgatggatatttatgcggaagcaacagatgtgaagaaaaaggaagcaattaaagctctggaaaataatagtgatatattttaggaagaagtccttgcaaggggacgatttccaagacaaacctgacatcaaaaaagtcagaatacatcaaaatgacattagtttgttggattttggtggacaaatatggactggcgatatataatgaaaatcgtgtaaaaaagcgtttatcaacttatttggactgtggtggattagcttcggttatattcccgacaatgaagtctattgataagtaagaatgcaggaaaatcaagggtttcagcacttggatgtactaaaatatatagttggtcaaggggttttgaccaagatttgaccaatttttggcatagtcaaaaaagattagtacaggttagtacagattgcttagtctgaaaaattaaagattgtattacttagaggacattttctaaagaaatttagaagatgtcctctttttgcgttataggaacaattgaaataccgaaaggagaatagcatggaacacacaaaggcatatcaggaatttaagaagaatggtaatacaaagtttgtaagatatagcgaaggagcagaaatgtatcatatgggcgtatcaaagtttatgcaaatggctaaggatgccaaagcaatctataagttaggtcagttagtacttgtgaatttaaaaatatttgatgagtaccttgagacattccatatagttgatgatgaattttataagtaggtgaaaaggatggtaacacaattacagccagatgttagggcttatcttcatggtggggaggtaataaaaagatacataaaggtcgaagaggtggcttatgaatatggatttagtgttgaagaaactgaatatatagctaaggctgcaagttctttatataagcttgcccgtatttatttggtaaaaaaggaaaggtttgatgagtttatgaaacacatatataaagtgccgggaacaaataagcagataatcaaaaagtttgcgaaaattggagaagcttcaattatatacagtattggcagacatagatttatcgagttggctagagcagcaggtgcaacatataaaataaatgagggaacagggggggctgtgctaattaatttagaaatatttgataattatatggagcaattcagacaacctgtaagacctttgaaagagatgttcaagtggctatttaagaagaaaggatgtgcaaaacacatgaataataagttagaagtaatcggcattgatcatggatggtcaatgatgaaaacaatctctcaggtatttgtcacaggtgtaaaggagattacaactactccggcacttttcggtgatgtacttgagtatgaagaaaagttttacaaggtcggaactgtaaggcaggaagtaaaggatacaactgttattttaattctatgaagctagcaatggataatggaatcaggtctattgcatttccttctatatcaacgggagtatttagttttccggttgagttggcagcaaagattgcagtacatacagtaaataggttcttgcaggataatccggattgttttgatctggtggagtgggtgctatttgatactcagactgaatcggtgtatgaatctgaggttgataaaatatattaaagattaatcggtttaagattggttagatctctttgtttaaaccgattattaaaccaattagtactcaaactgctatataataggggttatgattggttaaatagggtcaaattcaaccaatttgaaaaaaatgtcctatttcgtccataaatagtatgtatatggtatactagctaatagtaatgcggtttcaaccgacattacatattattatgagaaattaatgcaaaggagttacaatcaaatggataacaatgaagtagtaacagaagaagtggcagcagttgttgaaaataatacagggattgagattgagccattatttgaggaatatgttgattttgacacattttcaaagtcagacttccgtgttgtaaaggtaaaaaattgtgaggcagtacctaagagtaagaaacttcttagatttaaacttgatgatggtacagagaatgaaagaactattctttcaggagtacatgctttttatgagccagaggaacttgttggaaagacattattggcaatcgtaaatcttccaccacgttctatgatgggaatagattcatgtggtatgcttctttctgcaattcacaatgtaaatggagaagaaaaactgaatctggtaatgttagatgatgcaattccagcaggtgcaaaattgtattaagagtataaatgtcacatggttgttaataactgtgtggcattttatcgttgttgttgataagaatgtgaaaagcaggaggaactacggagagaggtaaaacatataaggttattatgtgactttgatgataaagtagcatatatcattggttatgttacatacaaatgaggttgcagatattagtgaaagaatgattgagtagaataaattattagtattttattaggaaggtggaatatatatgaaacaagatactttagagggcaaagcaaaaacaaaaaatggggtaaaacggctgtgtttttccataatctgcattcttctggaagtgatttttattattactatcgtaacacgcttgaatgaatatgcagaaatcataaatttatttacaaggattttgagtggaatcttggttttgggattgtacgcatcaaataagacatcctctatgaaaatgccttgggtcatcttaattctaattttcccaattatgggtgtaggcctgtatttgttgattggtttgaatggtggcacacataaaatgcgtgagcgatatgcagaaattgatagcaaattgttaccaatgcttccggacagtcaggagtgtttgagcagaataaaagaaacaattccgaaagcaggaaatatagcaagttacatacaaagaaattcgcagtatccaatctatcagaatacggatattgtgtattttgatgaagcagtgaaaggattagaggcacagcttaaggatttggagaaagcacagaagtttatctttatggaatatcatgcgatagaagacgctgaagcatggcataagattcaagatgttctggaagagcgagtaaaagcaggtgtggaagttagagtattctacgatgatatgggttctataggctttattaacacagattttgtgaaaaagatggaggcaataggaattcattgccgtgtattcaatccgtttatgccaggtttaaatctgtttttgaacaatcgtgatcatagaaaaataacagttattgatggaaaagtcggatttacaggtggatataatctagcaaacgaatattttaattacacacacccgtatggacagtggaaagatacaggtattcgtttagaaggagatgctgttcagtcgcttacggtgacatttttggaaatgtggaatgcagtaagtgataaggatgctaatgattctgattttagtaaataccttttccactatgattatgcggcacagcaaactgggtttgttcaaccttatgcagacagcccgatggataatgagcaagtaggagaagaagtttatatcagtatgataaataaagctgaaaaatattgttggtttatgactccatatctaatcataacagatgaaatgacgcatgcgttatgtctggctgctaagcgaggggtagacgtaagaattatcacacctggtatccctgataaaaaattcatttataatataactcgttctttttatcatggattagttaaacatggtgttcgtgtttatgagtggactcctggtttctgtcatgcaaaaatgagtgtggcagatgactgtatggcaacttgtggaacaattaatttggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactgggacaattatttatgagattatttgctggattgctataagaatctgatggaacgacctttcaaaaaacagttgatttagaagttaactgtttttgaaaggccgtttttgctatatctaacagtctgttgtacaaagaagattttgcatggatgaaaaaacaaaccttgttgaggttaaattgagttttccattgtattgtattgctaatgaataagaataagaaaaagaacagacaatgctgaatgctctggaaacaagaatatctgagtatagtatgtaagttcgtaacagaatgaaaggagcgattcaaatgagcaatttggaaaattatatgaaacagcaagcaattttttgtgaacaaaatgatagcattagtaagaatctgtattcagagtatggtgtaaaaagaggcttacgagatgaaaaaggccaaggtgtgttgacggggcttacaaatatttctgatataaaagcttttgaatattgtgatggagtaaagagtccatgtgatggcgagttatcttatcgtggttataatataaaagatttagtaacaggaagtaaaggaaaaaggtttgtctttgaagaaggagcatatcttcttttattcggagaattgccaactgatacacagttaatggaatttcagggaagactatctgattgtatggaactaccgactaactttaccagagatgtcattatgaaagcacctacatcagatattatgggttctatgactcgaagtattcttacattgggctcttacgataaggagaaagaaagtcttgaaattccgaatgtgctaaggcagagtatgcagttgatcgcagtatttcctatgttagcagtatatgcataccatgcttattgtcattatgaaaaaaacgaaagtatgtatattcatagacctgaaaaagatttatctattgctgaaaatttcctgcgcctattaagaccagatacaaaattcacagaactggaagcaagagtactggatatagcattattgttacatatggaacatggtggtggtaacaattctacattcactacacgggtagtaacatcttcaggttcagatacttattctgttatttcagcagcaatgtcatccttaaaaggaaaaaaacatggcggtgcaaatctgatggtaatgaatatgatggatgatattaaaagtcatgtgaaagattatgaagacgaagaggaaattgcatcatatctgagtaagattttgaagaaagaggcgtttgatcagaaaggacttatttatggaatgggacatgctgtatattctatttccgatccgagagaaagggtgttcaaaggctttgtagaacaactcgcaagggataaaggacgtgagaaagatatgaccctttataacaatattgagaagattgcacctaagttgattgcaaagcagcgtcagatattcaaaggagtaagtcctaatatagatttctatagtggttttgtgtatgacatgttgaatattccaagagaattgtacacgccattatttgcgatagcaagaattgctggttggagtgcacatcgcctggaagaattgataactacagataagatcattcgcccggcatataagagtctagtcagcaaaaaagaatatatagaaagagaggaacgataatatgggagcaggaaccagtgcagaggagttttttttaaagagcatcaatgttgaaagtatatttgaatttgtcgaaagaacagattatttgttcctttatagtataaaggaatgtgttgaaaaatcagactgtcatgaaggagtatatctttcagaagtggcagaatacatgaaattatcgattccagaaacatctaagatggtaaaaagtcttgaaaataaaggatatattatctggaaattagatgaaaaaaaagaaagaacgtaccttgttttgacgaacaaggcaattgaattaagtaattgtcagaaagaaaaaatgatagaagcttatgaaaaaatcatatcgaatatacaagaagatgacctggaagttacacggtgtacattgagaaaaatccgacagcttatggaagaaataaaatagtgattaatacaacggagtaagaaaagctccttcatatattagaataaaaatatgactgtttctttaaaaagaagcctgtcatatttttttatgaaaaataaattttgttgaggttaaattgagattgactttgtattgtatcagtatgaaataaaaaggaatcaggtgatgtacaatgaaaaagtataaaatatgtaaaatccttcttgttatactggcaatttttttatgtatggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgatcaagaatgcaaaaaaggaaattattctttctacttttgcatttcaatccgatgaaagtggaaaattgattttaggagcactgcatgatgcggcagacagaggtgtacatattcgtctgttagtagatggaatggagagctggattgatatggaaggaaatccgtatttctatggattatcttcccatgagaatgttgaaattaaactatataataaggccaatccgttgaaaccatggaagatgatgggtagaatgcatgataaatatttgattgcagatggaaagagatatattcttgggggaagaaatacatacaattatttcctgggtgattttccgggacataagaactatgacagagacgtgttagtagtttgcgatgaacctgagaaagaaaattcagttaaccagttgttagagtattttgaaacgatatgggaacaagaagacagtggttattttcatgacaataaaaaactggcaaatagaaaatctgtaaagaacgcagttttagagctgcagaacggctatcagaaatattttgaagagaataaggaaagaatctgcgataccgattacacggacgaaacttttgagacagaaaagattgcattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaggagattgcagagaacgattcagatttttctatcatgacaaattcagttgcaaataatgggaatccatttggggctgccgattatgcgaaaaacagaaatagaatcttaagtacaggaattaatatctgggaatatgaaggcggttattcataccacggaaaaagtattctgattgacgatgatctgtctgtaatcggttcctttaatatggacatgagaagtgcatatctggatacggaactgatgcttgtaattcgcagtaaagatattaataaacagttggaagagggcatgatggaatatgaaagagtgtcccgccaggtattggaagatggaacctatcgtgatccatatcatgtagagccaatcgaattaacaaagaaacgtcagagaaaaatatttttggtacagcatctgcttggatgggcaaggtatctgttttaataaggaggaaggaaaacgtgtttcaaatattgattgtagaagatgataaagaattaagccagctattccaaaaagtgcttgagaagaatggatatcaggtcaaaagtgcatcggatggagcactggcattagaaatattggataaagagtatattgatctgatcatttccgatattatgatgccggttatggatggttatgaactggtgtcggaactccgttcagcaggatatcagataccggtacttatgatcactgcgaaaggttcctttgatgatatgcgccagggatttctttcgggaagtgacgattatatggtaaaaccggtaaatgtgaatgaaatggttttaagagttggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagagagcgttttaaagataaccctgattttgaaatcgtaacaatgcgtggaattggatacaaggtggtgaaaaaataatggaacaaaagaaagaaaaaggattgcggatccgatcctgtctgactggtgcaatctggctggcactcgtattttcaacagtcatatctgcgttattatttgcttttttgaatcatttttttaatctgcctggtagcatacctgtgcttggctggcttttgattttcaatacattgattgcagggctgatcacttcctttatcaatgcaaagttactggaaccaattaccagacttagtaaagcaatgaaggaagtttctcagggagattttgaacagcatttggaaacgaacagccgtatagcagaagttggagaatcttatcaaagttttaacgttatgacaaaagaacttcgtgcaacagaggtgctgcagatggattttgtatctgatgtttctcatgagtttaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagtccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcaaatttgttgtagagcttccaatacagaaagatgagaccatataagtttaagaaaaacagatagaggaggaattacatgacattttatcaggagttgcagttaaatcaggcaggttctaaaaacctgttgaaaaagagtgaaacactaaaagaaaaattatatcatatgtgggtatatctggtgaagatagctgctacaatggcattttgttttttctttgttagtattttcagtatcctatttggaaatgagaacagcattgtaggtgtagtagtcttattatgtctcatggtgtttagaaatgcggatctggggatccacaccggacaatctacgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacgggaaaaagctatcaaatgcgattagtcggaatggctttaggtgcagcacttacctgcttcgtattttatcgaaatcataaaaacagaacttataaaagaaatctgaaagatctgatacaagaatttgatatcacttcttccagaacaaaatggcagatatgtcagattttatgcgtaccgattgtcctttgcattgcagaactttgtaatatgccacgtgcaatgtgggctggtattgcggccatgtcagcgattttgccgtttatggaagatatgcactacagagtccgtaaaaggattgtcggaaatattgcaggtgttatatgttttacagtattatattttctgcttccttcgtcaatctatgcatatataggaattcttggtggaatcggtgtaggattttcagcacaatatggctggcaggcagtatttaacacatttggtgctttagccattgctacagagacttatggactacaaggagcggttagtcttagagtgattcaaaatgtttttggtgttgtgtttgctttagcattttgtgttatattttattggtttatgtctaaaaaaaaggaaagtgatgtgaccgtacatgcagagtgaagtgaatcaggaagaaaatttgaatagaattattacggttcctaatcttctttctttttttcggctttgtctgattccggtaattatatggagttattgtgtaaagaaaaatcctctgttagctggtgaaatcttattgctgtctggtcttacggagcttgctgatggatatatcgcaagaagattccataggattagtaatttaggaaaaatacttgatccggtggctgataagctgacacaggcagcgatgttaatctgtctgtttactcgttttccgcatatgcttcttttaatcgtaataatggcaggtaaggagctgtatatggtagtcagtggatgtcttgtgatacgaaagacaggaaaagtacatggtgcagactggcatggaaagatagtaacctttttattatatggaactgcagcggtgcatattatatggttccaaattacaccgatggtatcagatctgttgattggtttgtgcgctataatgatggtcatatcggtcgctctgtatattatccagaataccaggactcttaagggagagactgtataagcaattttatattgcaatgactagaaaaatatttaggagaagatagatataaacagtaagtcaaacacacaaactatggagtctttagtcggtttaataaaattttagatagaaaataaatcattcaatgtcatttagataaggttttttatgacaaaaagacagattgcttatctgccttataatgcagtatgatggtaacgagatttatgcaacccgatacatgaaatccctatttctctttggacggaggtggataggatattttcgattgtacttgacaggtgtcagatacttttgtatgagaagcatggactctgtttcgttaccatcgtgtttgagatatgccctgcatatgtttactgcatttgaaacggatttactctgcatctggagcataaactgaatatactcgcggaaagaaagtttgcggttcctggtaaaatcactttccggattacggcagaacatggagtgaatttcatcgagttctgtgatgcagttgtcgagtgtggattttaaattagataagaaaaaatcagccataatgagcctccttgaaatatgtttataatcaaggcttgcgcaacatatattggcttacttgtcaactgttttttgtaatatttttaaagtttttaggcataaaaacagtggctttctatgacagaaaaccactaaaatgatgcttaactgaatggcattgctttatcaccactttgaaaatggttgttttatgacggatagtcagacagttttggatataagagatgatctgggagcaatcatgaatgaatgcagggaagtgaccgaaaagtaccgcacaggacggagtgcatatttacggctcggacagttgtttatgagattgtttgcaggactattatagcagaaagaagaggtgttcgatatgtgtacagcagcaacttacaaaacaaaagatttttatatgggcagaacgcttgattatgaattttcctatggggaacagatcacgataacgccaagaaattacgaatttgatttccggtttgccgggaagataaaaagccattatgctttgatcggaatggcatttgttgcaggaggttatccgctttattatgatgctgttaatgaaaaaggccttggaatggcaggtcttaattttgtcggcaatgcggcatatgaagaggctttgccggaagatgaaacagaagtcagccaagtggcacagttcgagttcatcccatggatccttacacagtgtgctactgtagcagaggtgagagagaagctggcagcaatgagactgacaggcacagcattcagtgaacagctgccgacagcacagcttcactggatcattgcagacaaagactcctgtatcgttgttgagtctatgaaggatgggctgcatgtatatgataatccggtaggagtgcttaccaataatccaccattcccgagtcagatgtttgcactgaataattatgccggagtatccagaaaacagccggagagtacttttgcaggagtattacagcttgatgcatatagcagaggaatggggggaatgggaatacctggagatctttccagccagtcaagatttgtgaaagttgcctttacaaaattaaattcgatctccggtgaagaagaggatgagagtgtaagccagttcttccatatcttaggatccgtagatcagcagcgtggatgttgtgaggtgacagaaggcaaatatgagatcacgatatacacgtcctgttgtaatacagcaaaaggtatttattattatacgacttatgataatcatcagatcacagcggttgacatgcatgcggaaaatctggattcagatcagctgatctgttatccgcttctgtccaagggcgaagtcagatggcagaataaataatacgaaaatgcacggagaaagcatatcgcagaacaacaggaggaagaccatgaaagaagttaaaacaccgaaaaaaccactggcatattattatgggattgtgttaatagtgctgatcgtatttaatctggttgtcacaccaatccttatggagcatcaggtaaaggaaacggattatggaacttttttgagcatgatcgagaagaagaatattggtgaagtagaagttaatgacaatcagatcatctttacagataaagatcaaaaaaatatttataaaacaggtctgatgaacgatccgaacctgacggacaggctatatgaatgtggagcagtattcgcaaaagatatcgataagcagatgtcaccgatcatcagcttcttgctgaccggggttttgccattgatcctttttatcgcactgggaaattatatggcgaagaaactgatggagcatgccggaggaaaaaattcgatggcttttggaatgggaaaaagcaatgcgaagatttatgtgcaatccagtgagggaatccgtttttcagacgttgcaggagaagatgaggcgaaagaaaacctttcagagatcgttgattatcttcacaatccgaagaagtataccgatgtaggtgcgtctatgccaaaaggtgtccttcttgtaggacctccgggaaccggcaaaacaatgcttgcaaaagcagtggcgggtgaatcaaatgtaccatttttctcaatgtccggatcagaatttgttgagatgtttgtcggtatgggagcttccaaagttcgagatcttttcggacaggcaaaggaaaaggcaccatgtatcgtgtttattgatgaaattgatgccattggtaaaaagcgtgacggacaaatgggcggaaatgatgagagggagcagaccttaaaccagcttcttacagagatggacggatttgaaggaaataatggtgtcatcattcttgctgcaacgaaccgtccggagtcgttagatccggcacttacacgtccgggacgttttgacagacgtgtgccggttgaactgccggatcttgcaggccgtgaagcaattttaaaggttcatgcaaagaagataaaagcatctgatgatgttgacctgcatacgattgcgcgtatggcatcgggggcatccggtgcggagcttgccaatattataaatgaagcagcattacgtgctgtccgtagtggaaggaccgttgtaaatgaatctgatctcgaagaaagtatagaagtggttattgcaggatatcagaagaagaatgcggttctttcagatcaagagaagaaggttgttgcatatcatgagataggacacgctctggtagctgcattacagagtcattcagctccggtccagaagattacgatcatcccgcgtacctcaggtgcactcggctacactatgcaggttgagcagggtgataaatatctgatgacgaaaaaagaacttgagaataagattgctacatttacaggcggacgtgcggcagaggagatcgtatttggtgagatcacgaccggagcctccaatgatatcgaacaggcaacaaaaattgcaagagcgatgatcacccgctacggcatgacagatgaattcgacatggtggcaatggaaaacgtgaccaaccagtatcttggcggcgatacgtctctttcctgttctgcagatacacagaaggaaattgatgaaaaagtcgtgcagctcgtaaaagcagagcatgaaaaagcaagaaaaatccttgctgaaaacagggaaaaactggacgaactggctatgtacctgtatgagaaggaaacaattacaggtgacgaatttatggatattttagacagaaaataatgtagttaattagataatcaatgtcatttagataagaaaaatagttagtagttctgaaaaatggaattattttatataaaggagcggacaaattctcatttacagggagcggaagattgagctggataaaatactcggctcaatcttccacatggaatacatcttcgaccagcatattaaagtactttgatatccgcagcataaattcggcagatggggtgctgtccccacgttctatcctgccgaccgttttggtgctgtatccgatagcagcggcaaggtcatcctggtaaatgccacgctgttcccggatttctctgatattattagtaaccgccataaaaatcccttctttcagttctatagatattttcttattttcaattatgcaaaataatgtgtccaataaaaaggacttgcaattttatcagcaatgtcctgtgatagcagaagcatcagattttccaagaacttttccaaatatgtctaagcggtcgttttctccaaccttgataggtgcatacttttcattaagcgagataaggaaaattccgtctttatcgttttgtaatttcttgatgtaggcttctccgtttagagcgaagatgccgatttctccattagcaacagattccagttgtaatacccatgcaatctgaccatcgtggaattcaggttccatactgtcaccactaatgcggacaccgaaagtagtatcttccggcaggatagattcatctatgcgtacagtctctttcggtccgtctacaaggaagttaccggttccggctgatacggcattttcaaaaatatcaatgctacggaatggaattatcttagcagtctgcttttcatacattccggatgcgtggagcagattgatataatccatagccttttccctgccttcatcagtaagtgaggagaaaggatcagtaggatttactccaaaatatgcctcatacatgttagtaataccaaggattctacacactttgtaaaatatggtaacgcttggttcagcaagatttctctcccagttggatatggctttataggaaatggtaatgccttcctttgccagttcatcagcgagatcctgttggagcaagcctttcttttttctatatgatgaaatgatttctccgattgagtacatacatacgcctcttttctttcattttgttgatttcaaatgtctcttttcactccatagtatatagcaatagtgccaattattcaagttaaaaatccaatataatgagaaaaatgacacatgtgtccgttgacagtcgattattcttggggttatactatgccctgtaagaaacattactcatatacttggactaagagtcaaattggaaggagtaagcgctatttaacaaaagatagatcagatatgtgttattcagatgaatggaagttgattgtacccaaaagcttgtattacacaaaaatagatgcacagattgactgaccaattatttagtattgatgtacatttattcttttgctcctgcaaatttcattgttttacagacggaaacaagagaattgcgatcacgttgactgcagatttcttactgagaaatggatacatgggaattgcaaatgtgtatttcagagaaatggaaaatataagttatcatgtggcagccgggcacatagatgaggagcttttaaccgagctgatgactgctatattagataatacttatgataatgatgaagcattaaagttaaaattatttaatgccatttctgttgaagagcagttttacgaatagttttggtcccgacattaatgtcgggaccaaaactagtttgcaaagggcagacagggaagctcttcaagaaactatgatgtattaggaagagaactgtttacaccggatgaagtcagaaagctggataacaaaaagtgtattatctttatccgtggttttgatcctatcatggataatataagttcataccattcaatcatccgatgtttaatcagacagcagatggcaagggagagccttatgttcatcagataaggggagcagagaatctcatcggtccaccatttgagattctttcagacaaggcagttaagtattatgaaaaattaagggataagggagagaatgtatatatagactctcttacctatgagcagtttatgatgcttggtgatgcggaattaagcagaagattctccatgcaggatgaaacagaacagaaagcaaagattgacagggagcagtcgaatgagcttgagtatgtcgatgaatcgcagaagtctgatgctgcagaaagtgccaacgcttctaatggaagtgctggtgctaagcctgtaaggaatcctgagagggaaaagcctaagtgggaggatactatcacaaactgaatgttgcattggtcatatacgccggagcagaaagaggaagtgaagaaagctcttgctgcaggcgttcccaaagcaacgattcttacttacttctatccagaggtaactgtggagaagatgagttcatatcggaagaagcagtaaatgttatcgcataggcatgtttactatggtataatgtgcctatgtgagaaaaattattatttagaacttatttgcttatatgataagcagaatggaggctttgcgagatgaaagtaatcattataaatggaagtgcaagaaaaggaaacactcttacagcgattgaggcttttgtaaaaggagcatctgaaaaaaacgaaattgaaatcattgaacctgacaaacttaatattgcaccatgcaagggctgtggtgcctgtcaatgttctaagggatgtgtagataaggatgatacaaatcctacaattgataaaattgctgccgcagatatgatcctttttgcaacaccggtttattggtggggaatgtcagcacaattgaaacttatcattgataagtgttattgccgtggaatgcagttaaaaaataaaaaagttggcacgattgttgtaggcggttctccagttgacagtatccagtatgagttgattgataagcagtttgactgtatggcaaaatatctttcatgggatttgcttttccagaagtcatattatgcaacagcaaaggatgagctttctaaaaatcaggatgctatgaaagagcttgaggatattggaaaagatttataaagcttgtataatgaaagtgacaaaacggttttccttcatgctggtctccttctgtttattcccggtaaatctgtgcaaaccggaaatttctgatgaataacatggtgcaggatcgttttcgattattatattttactgtgagattgtgatattagcaatagtgaaatggggcagagaagagttgaaaaggcagacggataagaaacaaagataaaatagtaaaaatagaatagaacaaagaaagaatatggagataaaacagaaaggaatagacaatgaatgtaaatcctataacaagattggattatccagatctggacgtgatccgcgtagaagacacctattatatggtatccacaaccatgcattttatgccgggctgtgagattctgcagtcttttgatctggtgcactgggagcatgtgacttatgtctatgagacgttggatcatacggatgcgcagcaactgaaaaacggtcagaatatttacggacagggcatgtgggcagcttccctgcgctatcatgaaggccgattttgtatctgctttgtggcaaatgatacccgtaagacttatttgtatacttcggaaaaaatagatggtccatggaaaaagcagctgatagaaggcttttatcatgacggctctttattatttgatgaggatggcagaaactatattgtatatggaaatgatgaaatctggattacagaattgaatgaagatttgactgcaccaaagaaggacggattacatcgtcttttagtcagtgatcataagaacccggagctaggctatgagggttctcatattcaaaaaataaacggctattattatatttttctgattcattcccggagagaccgctggatgcggacggaagcatgcttttacagtgattctctggaaggagaattcacgggtggagatgtactttgtgatgatcgtggatattgtggacagggcgtggcacagggaggaatagtggatacgccggatggaaagtggtatgcaatgctgtttcaggatttcggagcagttggacggattcctattctgcttccggttacctggaaggatcattttccgttttttggacagaacggacatgtgccggaagaaatagaggttcacagtaccagaccaggatatatttatcagccattagtgggaagtgatgatttctgtaatgggctgcttccgcgctggcagtttaatcatgatccagatccacggtactatcatctggatgcattgcagggaacctatacaattacaacacgggaagtttgtacagagcttacacaggcagtaaatacgcttacgcaaaggatgagttatccgtcctgcgcagctgaggttactgttgatgcttctgcattgaaagagggcgatgtcgcaggtttgtgtgcgttgcagagctgttatgctgcagttggcattacaaaacatcatggaaaatatgaagtccttatgctggataaaaaagaagatggtatattggatatgacggaaggaactattgttgaatcacaccagatggattttcgtcttgaagcagatttctgtaacatgaaggatgaagcacgctgctattaccgggtaaataagggagactggctacccatcggaaccgtgcataagctgtacttcaaactggatcattttactggttgccggtttggtctgttctgttatgcggcagaggaaacaggaggaagtgcctgcttccgggattttaagtattatgatgttgatgaaatctcataaagatagaactgcataaaataagtgtcggaatttactcaaatttttcctactttggacattggtttttacaacggtattgtatagtgaagcagaggaaaaacaaaacatgtttcagagaggagaaatgattatgagaattaagagtatgatgaagggtatgcttgctgttgtaatggcaatgtctatggcagcatgctccggagcacctgcagcagaccagacttcttctgagtcaccgtcaccggcacagacagaaagtacagcagcaacagagcaggaaacaatcgtaacagaagtatctgcagaaacgcagacgcaagaagaaacagcaaaagcaccgaaatatgttttctgtttattggtgatggtatgagctatccccagtttcaggcagcatctgactatcttggagcaatagcagatgaagattatgtcaaggcacttccgagcaatagctatgaagaccgtggaggagcagtactggacggaccggaagcaggatacaaggttacctatacacaggctgatgcagaagcggttaaagctcactgaatctatcgtggggcttcttactatgattgcaggaggcggtattatatattaccttgtctgcaagagatggtcagatgtctttcttatgtctctgatctttgcagctatcatggctcttttgctggctgtcataacagtgcaggattggtgtgatatgctgattgaaaaaattggcgcactctgaaatccgtatacattaagggtttgagcatgtctcgaacccttaaatgcttttataatatcttgtgtttctatttgacgtgtgttaatctttacttgaaaaaggcataataagttaaatatgagacattgtttatgcatgtttatctttgcttatgaaagtgagcatcggtaaactctcaagaacaaggaatcaaatttaatctatcatgtctggcttattcagcgtacccgggatacgtggattttctgccagactatctttatgccttttagtataaatactaggaggtctttttttatggacgagaaagaaatcaaatttatccaagatcaaattggatacacgttcaaaaaccaggagctgcttgttcaagcatttactcgtcgctcctattcaatggaaaatggaggacaggataatgaggtccttgaatttatcggagacaaggcattggattttgttgtcgtgaagcagctctccgaggaattcggccattattcaaagaagtatcagaactgggaaaagtggggtaagaccgaggaaacgggaacctttatttctgatttggatgagggagaattaactgagattaagaagcaattggttcaaaagaacactcttgcagatgcaatcgacaacttagggatagcctactatctgataatgggaaaaggagatgtcgagaaaaacattcaggattcactatcggttaaagaggatctgtttgaagcgattcttggtgcgatagccttggattcaaattgggatattgaagcattacaggatagcatgaatgttatgctgaatccaggcgagctcatgtttgatgaagatgtaaactatgtggctgagatacaagcttggtcatcggctaattcaggaaacattccacttcactgtttctatcctacttccatgcagggtacatggtatatgccaaggcatcatatgtgtatatatggaaaagcggagcaggatacgcactttgcgtgtgaagttctaataccgggaattgattatcatttcgtcggatacggcagatcaaagaatctggccaggatggacgcatcgagattggcgtatgaatatctgaaagatgaggatatgctcttttctattagagatgagattgatgatccgaattataatgattccatcgggcagttggagatccttgccagaagaggctatttctccatccctcaatatgacttcaaagaaacgcatgacgaagatggtaatccggtttggaattgtaaatgctctataaaagaaaaagatactgtaaccaatggaagatcttcgtctaagaaagatgcgaagaaacaggcagcatatgatatgctgacatttgttttggaggaggaataagccatggcaaaatatgcattcaattatgattccggcgaatatgaatatatagaaagagacggcttcagtatagatcgtggtgaatacgtttataactgggatgacagtgagtatcgccgcgaggaagaagaggaagaagagcgtcgccgggaagaacgaagaatgtggaatgaggattgaccagagggataataaatgaatcatgacattgagaaagcattggataatcttgaaaaaagggcacaggatattcaacactatatgaatattatgagcaaagtaaagacggttaacgttgccgatgatcaagattttcagcgggaatttgactttttttacaaggttagacgaaatgcagaatggcggaaagtattctttgagattttcgaaaggaagaaaaagaagaattgttcctacaaagaaattataacggaactgtacgaaggaaccggacaagttgaggcatcctttgcgagtaagatgctggcatctatagatgagaatatgccaatttgggattcgaaggttcttgatagaattggaattaaatcttcaaataaatgaggacagcaaaaactcgaggaaacaattgagttatatgatgtcattgtacaatggtatagtgatcttaaggcaaacaaggcaagctataacgaatatataacatcctttgatagtcgttttccggattattcatcaatcagcgataccaaaaagattgattttatactgtgggcgatgggcgaagaggaagaggatactattccatctgtttatattcaaaatatggaggccttatcagatgctgcaaagattgcatcccgctccatagaagcatatccgggagttgtttctgcggtaaaacaaattgctgattgtatgaagcagtatcaaggtatctcgcaaacctttatggaaaacgctcgtagaattagtgagactatccgccccatttttgaatatcagcaacagataatggaatccgttcggccagcactagaatcgttaggtaaaacaattgcggctatcactgctacaattcctaaaattgagattccggagtcattttttaagactctaggtaacctaagatatctatatacgttaaaaagcattacatggccactatttcttgaagatgatgaggaattaaaagaaatcattacgggtctatgtggggataaaaaagaaaactatccattggatgaattggctgcatctatctgcaattactataattctgagaaattagataatatagtagacggatggaggaaactattgaaggatgatttagagagattgctgttattggaggaggcagttaatcttcacaactctggatgctattatggtgcgacttctatcatgatgtgtcaagtggatggtctgatttgtgacatttcaaattatacagatgaaaatggcttaatatgctcggaagatgatgagaaggagatttgtgaactctaccggattgattttcagaatcataagaaatttgcgaagacaagcgaaaagcatatgattttgaggttggctgcaatgacagaaaatgctgtcttttattgggaagcaatgactgattacatatacaatgtagtgctaacgagtcatggggaagaatatcgtgatcataacccgctgagaaataaaatctgtcatggcgatcaattggatttcggaacggaggaaaaatcgctaaagagtatttttgtaattgatttgttacttaacctaaaaagcgaaatgcaatggttggctgagcacaaataaatttgataaatgaaaagtctaatcccccagctatgctggggagaatggaatagttggaaacggtgaggataaaaaagaaaaacctcctgtggtatattgagaatggtgtcgcaagccaaactcaacacaggaggtggtccaagtggacaataaaagcatatcacacactagatggaaatgccaatatcacatcgttttcattccccaatatcggaaaaaggtattgtatgggaaggtaagagaggatgtacgtgaaatcttaaatacactatgcaaatataaaaatgtagaaataattgcgggagcagtttgtgtagatcacgtgcatttaagtgtcgcaataccgccgaaattaagtgtctcagattttataggatatttaaagggtaaaagcaccctaatgctatacgatcgtcacccagagttgcagagtaagtgggataaagcattttgggcaagaggatattatgtggaaacaatcggtaatatcacagacgaggcagtacagaagtatataaaagaacaagcagaagaatcgagaaagcgattgacgagatggaaggctatagcgaaatcatcaaggagaatattgagtatgacagccttcttctggctcatccatatgaccaggagatggtggagggaatttttgacctgattctggagacagttttgtctaaaaatggagagattaccatcgcaggagatgtgtatccaaagaatcttgtgaaaagcaaattcctgaagcttaattattctcatgtggagtatgtaattaattgccttggaaagaatactactaagatgcggaatataaaaagttatttacttgccagcttgttcaatgcaggaagtaccataagcagttattatagggctgagataaatcatgatatgccacaatatgctgggtaatcgcgcaacgagaatactatgtgtggttggtgcaaattctgcatcatccattgtaaaagtttaaaaatgcgacaaatcaacaactgtacaaaccattttgaaataaaattaaacttgactttgttggaaactggtattatattaggtttataaaagtgacaaattagtttacatataacccaagttgatttataaaacatggaggcgttgattttgaatctgtattttgaactattgaaaactccagtatttactgtgaaagatgtaaataaatattatgacaatatggacagcgctcgctctgcaatcaagcgattgatgaaggagggaatggtggcgaaaatccgtaacaatatgtatacctgcatcagtggagagacaggggcgccggttgctaatcgatttcagatagcaagcaagattacgccaacctcttatgtgtctcaccataccgctatggaatattacgggataactgatcaggtatattacgatgtctatgttgcatcagaaaccagctttcgagagtttgaatttgatggatatacgtatcgatatgtggcgtcaaaggatatggaaggcgtggaaacgcctgcactaagtggtggaatacgtatcacaaatcgggaacgaactttggtagactgcgtaaaggatatggataaaatagctggaatagaagaagtgatacaggatattggaagtatgaagcgaatgcaggagaaaagagtcttgaaatatttagacctattatcgaatcagttcctataccaaaagatgggatttcttctttctgagtataaggagaagatggggctttcagatgaattctttgatacatgtaagagtcagattggaaagagtaagcgttacctgacgaaggacatgtcgagtggacgatatgttgatgaatggaagcttgtgataccagagaatatttacaatatgaaaaatggggtgatagaagatgccacaatataatagagcagaacttggacgaatggccacagaaagtggttttgtgagggatacttttgaaaaggtgcttcgattgaaggaaatattaaaatttctgaatgaggacaagtccttaagagagcatttactcttgaagggcggaacagcaattaatttaactgtatttaaccttcctcgattatcagtagatatcgatatggattatactcctaatgatacgagagagggtatgcttgaatgccgtgcaaagataacggacataattaaggaatatatggaatcagaagggtatcagttatcggaagcatcaagatttagccatagcttggatgcatttcactataattatcagaacgccggtggtaatagggatatgattaagatagaactcaattattccttgagggcgcatatctttgaaccggtgtacagaagcattcttccatcagcatttgatgatggattgaaaatacgaatggtaaatcctttggaaatatttgcagctaaaggcaatgctctcattacaagagctgcggccagggatttgtatgattggtgcaatatgttgtctgagggtctctttgaagaacagcgtgatttgtttagaaaatgctttttattttatatgacgatttcagcagatacgcttaataaatcatttgacacctcagctattgacacacttgatttcaacaaaatcagaagagatttatttccagtacttaataagaaagataatttccagttggatgagagaaagaagattgcgaagaattacatatcggatctcatggtgttgactactaaagagaaggaatatattgatagattcgaagagaaaaaatacatgccagagttgctttttgaagacgcggagatagttgaaagagtgaagaatcatccaatggcactatggaaatgtaaggagtagattggctatgtatatattttgttccaaggcattagccgatgccttaaatatcaagaaaatgaattacagaaaatgccggtagatgctcaaattaatgaattatatgcctggcatggtcatataacaaagcttaatggaaagaacacgattatcctaatgaatgacagaacgatgtattcactagttttcagaaacagattgccaaggaatgttgataagtttgcagaactaatcaaagaagctatcccttataccatggaagtcggtggttttaataaccttgaaattgataagtatatgtccgggctggggaaaataatatttgcagagaaagcagataggcaaatgacaggtaatcttaccagaatgtttcttgatatggaatacacttgtgacagatggcaggaaaatgaaagtgttcaggcggaacaggcagcatttgaaaataatggaattagacggcaagggaaagaatatgtgaagccatttgagcggatgctggatgaactggataattgaaccatcgcaaaatttgcgacaattcaaactgaagagagtaaaatagtcgatataaaatgtgttagctaactaaatatgtttacagcaggtcgctaagtgccggtggcacttgtttagcgacgaccgaagtggaacgaagacagctgtgctaggctgttctgccgaaggctctgattgtggggaaaattctatggtcagggccttttctattgccttcaagtgcggctgcgggttcatgctgtcaacatatagaaaagtattcgcaacatagaatatttatcttgaaagtattcgcgtattcgaatataattaatatgacatgttgtcgttttatatggaggacatagaatggaatatttaacttcagcagattgtgcaaaaaaatggaatgtttcacagagaagagtggcgatttattgcaaagaaggacgtatagaaggcgctatcatgatgggaagaatgtggatgattcctaaggaagcaaaaaaaccagaggatcctagaaaagcaaaaaagaacatatagcaatgtaacagtgatagagagaaggtgagatattggctgaactgataattgatagaaattattataataaacttgatatagaaggcttttctaagatgatgagctctccttcgtatagctataaattctattggcttgaagcaattgtacagttgatatccgctaatagaacagaagtcacatatgatgaaataatcaataaaatgattgtgaatgcgtggttccctgtccaggaatatcatattcatttaagtggaatctacggggagggagaggtgaaagataatcttgaaaaggctgtatcaagattattcaaactatctgatcttccaagtaacgcggatgaaattcagattattaacaaactaaatgaattttcagatgacaaggaattacacttttataaaacagagcttactaagaatgtgccttataaagctttatctggatttgcaaataaaggaacagagaagattgacttaaatagcagcgcaggaagaatgatagcttattataatagattaagtgggtcagaaatcttgcttccatatacatttaatgatgaaaagagcttgaaaaaggttgtctcattcaatgatggctggattcagatgattcaagataatacggtttctattttaggatggattaagtatgagaaggtaaagtggttacagaacaataacccggaagtcccagggatagtatataaattaactcaagaagatgagaaagcaagaaaacttgaaaatgtaagaaaactgtgggatgcgattttggaaattcgaccagttaaaaatgtatttatggaaggtgacataaatagagaaagctacgctgtggatcactttattccaagaaactttgttatgaatgatgaattgtggaatttgatgcctatggatccgatacagaatatgcagaaaaataagaaacttcctgcatggaacgattattttgagcagtttgcaaataatcaattcataatgtatgaattgattcatgaaaagccaggtctgcaaaaactatacaagcattgttataaagataatttgcactcgatatgggcagtacaggagttatatcggaaaggaaattcaccgtcagagtttataaacatccttgggaaaaatatgcaaccggtatacgattctgcaagaagacaaggttacgagatttggaaggtttcataagggggcgtcataatgaaggtatataacaaattagtacgtgataaaattccagaaataattgaagcagacggtaaggtgtgtaggacacatattttatcaaatgaggaatatatagttgcgcttgaggctaagttgaatgaggaagtggctgagtatcaggctgataaaaatcttgaagagatggcagatgttctggaagtgcttcatgcaatttgcgtggcgagagggtattcattggctgaattagaggctatgagagctaataaggctgaaaagcgcggtggatttaaggagaagatatttttagagtatgtggaggagaaaaggtagatggcagaatgtatatattcaaataatatcaataaatccattttgacatcgggattcactattcctgtagataaatgggatatttttgcaaaatgtttaggggcaaatttgcaaaaaggcgaacgtaaggaaatagttgtatgggttggtcagttaaagtgttcagcctcatatacaaatgttaatttgactggggagaatgcaggaagaactgtatttcaagttagatattcaggggatttggtttcagaattacgaaagattttctcacctaactcagacaattatgatgcagtaggcggaaagctagaagtatactctggaaaagttggcgaactaacatttaaatgtttgcccgctgtaaccgtgaacacaataaatgaagatagtgctgtttcaacaacaccaggtgttatgaatctaaatacagtggtaacaaaaattctgaatgattatgtcccttcaaaaaaagaaacatttgcgggacatcagatgggatcgtttttcaggtcggatataccattagcaatatatgaaaccggaattgtagaatcagctccgtatttgataacaggaagtgtaggccagggaaattgggccatgattccatgggtttgtatattcgaccggaagattacgaccacagccacaaagggcatttacattgtatatctactttctaaggatggaaattctttatatctttcatttaatcagggatgtacagatataaggaaaaataattcgaagaaagatactattcgaatcatgcgtgagaaagccgaagacataagaaaacgaattgattctcgaggatttaatgctgataacaacgcaaaacttggggatggtttgactgagttgggtgaattatatcaggaaggaatgattttctataaggaatataaaaaagggaacgttcctggtgaatcagagttacagaatgacttaagactcatgatggatatttacaaagaatatgttaatggtaaagctgagaatacagagattatagatgtggaagtaggtgaggaacaattgtcaacaaaggatacattagatcagataaagaagtacatagcggcaaaaggctttacttttaatgaaggtcttgttgagaattattacctcagccttaaatcaaagccatttgtaattcttgcaggaactagtggtacaggaaaaactcgtcttgtaagactgtttgctgaagcaattggtgcaacaagccagaatggccgttataaacttgtttctgtaagacctgattggtcagactcatcagatttgttcggccatgtgaacttaaatgataagtttattccaggagcaatcattgattttgttaagcaggcagaactggatagtagaaatccatatttcttatgcttagatgaaatgaatttggcgcgtgtggaatattatttaagtgatattttatcaatcatagaaacaagagaatatgtggatggaaaagttacaacagatccgcttattacagaaaattattatggagcagatattactgcaaaaggaaaatatggtgttgtaagaataccagagaacttatatataattggtactgtaaatatggatgaaacgacattcccattcagtagaaaggttcttgatagggcaaataccattgaattttccaccgtagaattactagcaaattttgattctacgcagggcgaagtaaaagctattttcgcagataacacatttatgaaagctgattatgttttttttaatcagtgtgcttcagacaaggattttgtcgaagatgtttgtatagaacttcaggatattaataagattttggaaaaagcaaatgctcatgttggatatcgtgtaagagatgagattgtattctatatgcttaacaataagaatgcaggtaatcttttgacaagaaatcaggcatttgatcatgaaataatgcagaagattctgcctagaatacaaggaagtagcgcttcagtaaaaataatgttatgcgaattatttaagtattgcgcaggagattatgagagctatcagacggagagtgatgatgtaagtgcgaagatgatggcggctgcaaataaagaaacttgcaaatacaaggaaagtgcaaagaagattgctttcatggtaaggagatttgaagaggatggattcacagcttactggctctaatgagttgctatatgtgcaaactgaaaaagtaagtgtcaccataaaaggaaaggcaacacatcctaacttccaaggaattgagcataaaaacggcgattcatcaattaaggttcattgtgtagatgattttcaaatgactttaagggatggcgatgtaccacggttttcctcaagaaatggggaaatttcaacgggtatatattcaatctatccgatgttttatgagcaacagcagtatgaaattgtaattgaagctgtagatggacataaggttgcgttttggcatgataaccttaatgtgcgtaacaaggtgacacgagcgagtagaaatcatgagattttatctggcgtcatcaattttggaaatgaaattggtttttctgatttagtgatccaaattgatggtgttaattacttgcgccttgttatagaggtttttcctactaaaatcgattatcaaaacgattataagcagattgtcgaagatgtaactaaggaagtttacaatgttgtttttgatttccttaagaaaacatatttaggatatcagcagagcgaaaaggtgaatagtagtccagttgaattctttgcggttataaacaagatatacaaagattttattaaagcggcagataccattatgtcacagcctcatcatgtgctagatacaacacatcaagttttaccaagtcacaaagttaagaagactgatggcagaacgataagatggattaaaaagcatccagatcaagcgaagagagtgaatggagagattcgcattgaaagagcattggctgtaagaaaacaagtttcatatgatacaaaagagaatcagcttacaaaatacatactgctttcaactgcgaggaagttggaatcattcaaaaagaattatcttaaattgcagcgaaaagaagaccaggccgtaatagccaagattgacggaatggtgagagaactaaaccggcgttgtaatactacttttttggctgatgttgaggcaaaagaagcatcctccggtatgtcattagttttctcaatggctccaggatatagggatttgtataaatactatttgatgcttttaagaggattatctattacaggagatgtcttcaatatttctgtaaaagatttggctttattatatgagtattggtgctttatcaagctcaatagcatgatgaaggatcgatatgaattgatttctcaagatatagttaaggttcagggaaatggtttgtttgtatctttggtaaagggctcctcgtcaaaggttaagtatcgtaattcagagaatggagaagtgattacactatcgtacaaccctaagtcaggacaagttccgaccgtggcgcaaaagcccgataatgttctttcacttgagaaaaagacggtaaatcaggttggaaaaaaggttaaatatgaatatgtatttgatgcaaagtatcgcgtaaatcctgcgttggaaggcagtgattattacaatactatttcacatacacctggtcctgaaacggatgatataaatacaatgcatcgttacagagatgcgattgtttatcataatggtgcagatccatacgagagaacaatgtttggggcatatgtgttattcccttatgcaaataaggaagaatatagaaatcacaaattcttcgaaagtattgagaaagtgaacataggcggtttgccatttcttccttcagagacttctatggtacaggatatgcttgatgctttgatagctgattctccagattcggcatttgaaagagcaacattgccaagaggtattgaggacaagcttgccaagattgattggaatcaacgcgatgtgctggttggagcgttgagaaacagagcacagttggatacttgcttaaagtataagttttatcatatcccggcgtcaaagattagggatgcggatttaccaattcattatgtggcaatttatcaatctatcaatatctttgggagagaagcgggaatcaggtactatggtgaggttacaaagacaagtgctgtaaagcgtagagacatacgagagattccaaagaattctgatgaggcatattatcgatttgagattaaggaatggaaagaattaaacatcccattggttgcaaaagaagtcagggatttcccattctttacaaatatgttcttgttgcagcactgtccagatgtgccagatcttcatatcagttcagaggaagaatatcgcctgtacattgaagtacgaagattggcaaatgacgcatcggtcaacgagacggatgctgagcctggtttcaagtatgatgataagacaataattatggagaatggggacattgttgttcttaaggatggaacaaagattgagcaaatttctattgagacttttatgaggaaaccaagggagtcaatgagggtgatagcgaaatagaatattttaaaatagtactaataaaagaaagaatgactacattgttgcttactcccatgaacacgcctttttcttgaatgaaaagtctaatcccccagctatgctggggagaatggaatagttggaaacggtgaggataaaaagaaaaacctcctgtggtatattgagaatggtgtcgcaagccaaactcaacacaggaggtggtccaagtggacaataaaagcatatcacacactagatggaaatgccaatatcacatcgttttcattccccaatatcggaaaaaggtattgtatgggaaggtaagagaggatgtacgtgaaatcttaaatacactatgcaaatataaaaatgtagaaataattgcaggagcagtttgtgtagatcatgtgcatttaagtgtcgcaataccaccgaaattaagtgtctcagattttatgggatatttaaagggtaaaagcaccctaatgctatacgatcgtcacccagagttacagagtaagtgggataaagcagcattttgggcaagaggatattatgtggaaacaatcggtaatatcacagacgaggcagtacagaagtatataaaagaacaagcagaagaatcgagaaaagaagattcaagaagtaccgctttatagcggaccagtaaaaatgcttgtgacaccgccctttggggcgagtagtaacatagccctttggagggcttatagcaaaccaccagttgaactggtggttgctgacttaaaagaaaactatgaaaaatgctggtgttgaaaaataataaattgttgtattatgatgttgataataaaatatggaggtgtatcatgaaagcacataaatattggtcaatcggagcaatagttacaatggttggaactttttatacaggatataaagggttaaaagcagcacacaaatactttgcatttggctctctgatatgcatgattatggcagtctattctggtcataaaatgatttcaggtaataaaagaacaagaaaacaggtggaaaatacaaaagcggaggaatagtaaatgttagagttaggaataaaagcaccggactttgaattgccggatcagaatggagaaatgcataaattaagcgattatgcaggaaaaaaagtgatcttatatttttatccaaaggataatacaccaggatgtacgaagcaggcatgtggcttttctgagcgttatccacagtttactgagaagggagctgttattctcggagtaagcaaggactctgtagcgtctcacaagagatttgaagaaaaatacggactggcatttacgctattagcagatccggatcgtaaagttattgaagcatatgatgtctggaaagaaaagaaaaattatggaaaagtatctattggcgtagtaagaactacatatcttattgatgagcagggaatcattataaaggcaaatgataaagtcaaggcggcagatgatcctgaaaatatgcttaaggaattggcataatgaagattattttatcacctgcaaaaaagatgattgtagataccgataacttagcaccggttgaactgcctgtctatattgataagacagcagaagtattaaactggatgaaaagcaaatcaaaagaagaactgaaagctatctggaaatgtaatgacaagattgcagagcagaactttaacagattggaaaatatggatctttataacaggcttactccggctgttttagcatatgaagggattgcatttcaatatatggcaccatctgtgtttgaaatccagcagtttgagtatttgaaaaatcatttaagaatcttgtctgcgttttatggcattttaaaaccaatggatggtgtgactccttatcgtcttgaaatgcaggcaaaggttggaattggagatgcaaaaaatctgtatgagtactggggagaattgttataccgctcagtaatcgatgacagtaggattatcattaatcttgcatcaaaagaatactcaaaatgtatagaaaagtatctgacatcacaggacagatatattacgattgtattttgtgagttatccggagataaattggtaacaaaaggtacctatgccaagatggctcgtggtgaaatggtcagattcatagcggaaaataatattgaaaatccggtggagattcagaaatttgacagactcggatattcgtttaggtctgatttatcttcagattcagaatatgtatttgaacgcgaaataaaatagttattcaggaaaaagatgctcagtttggaagcttttataataatgagaattattactatttttattgacaacaggatgatagtggtatacaatccttattaagaactaatcctaataaggaggaaaatgacaagtaggagaaataccattcaaaaagatcttgtaagaaataccgtatacgaaatgagaagacacgttacggcaaatgaagtgtatgaatttataaaagaagcatatccaacaattggaaagggaactgtatatagaaatcttgatatattggtagaggaaggtgcattaagaaaggttgaagttccggatggaccgaaccgatttgattttacattgaaaaatcattaccatgtaagatgtataaagtgcggtgaagtttttgatgtggatatggatcaaataccggatttgctggaaagaattcataacactcatggaattgaatttgtggattatgatatttcatttaaaggcatttgcccgaaatgcagggagaaggtaaagaaggaacagcatggatagaaaagcaatgtataagttgagttatggactgtttatattgaccgctaaagaagcagaaaaagataacggatgctctgtaggaaaagaccagttctcagaagcataaatgtattatgataggattataccaatgaaagaagaactaagtatagatatcatcggacttgcaggagcctattcttatgctttggactgtatagaagcagagttggtaaatatcaaaaacaaacatggaaaaagagtggcttatataagtatatgcatggctgaatattggaaaattcaaggtgatgaattacaagatttagccatgtgtgctttactgcatgataatgctttgacacaatatatttcggaagaactgaaaaaggattccgtcattaattgtaaaaaagatttatccgagaaaaaaacaaatcttcattgtatttatggtgaaaaaaatattactaaaattccatttaaaacagatgtgtcaaatgtgattttgtatcatcatgaacatgccgatggaaccggtccttttcaaaaaaagtggaatgaaattccattgtttgcaaggattattcatcttgcagataccattgatattataggaaataatacgggatctggaaataacagttggaattttatatgtcagtaccttttaaaaaatagggatggattattcgattcagaatgtgtgaatgccttttttcatgcattcacacattctgaatcatttatatgtttacgtgataattcttttgaaacgaagctatgggagattatcccaagacaaaaacaggtttttgattggaaaacgtgtaaaaatgtcgcagatttttttgcaaagattgtagattataaatcttcttttacaagcagacattctataggagtggctgaaaaagcagctttttttgctcaatatatcggatatgattctattaatgtgcaaaaaatttatctggctggtgcactgcatgatattgggaagatggcagtaggcaatgaaattttggaaaaaccggataagcttacggatgatgaattttcaaaaatgaagaatcatgctggctatacataccttatattatcagaggttaatgattttgaagaaatacgagactgggcagctttccatcatgaaaagttaaatggaaaagggtatccttttggaaaaaccgcagctgaattaaatgagccggaacgtattatggcatgtattgatatttatcaggcattaaccgaggacagaccatataagaaaggtttatcgcacgaaaaaacgtgtgagatactcgatgacatggcgcagaaaggttttgttgattcggatatttccaagaaaattagggaatgttttggtggaatctaacattaaaacgagaaaatataggaaattcatgagaaatgcatttgcctgttatgaatagtatggaacaggttcataaaacaaataaacggaaggtaggattaatttatgtatgaaatgaaaccagaatattatatcggtatagatatgatagacgaagaacacaagcagttatttaaatatgcagatgaggcatatgaactgcttcttgatgagtttacaccggataaatatgataggattgatataatattagaaaatctccgaaattatacagtaaaacactttagtgatgaagagcagtatatggaatctattaattataagaagatatttacacagaaagttcaacatcaggaatttatacataaacttgatgaatttatggaacatcacaatgatgaggtagaagatcaagatgaacagattatgggaattttaaaatatctcacagagtggttagttaatcacattctgtatgtcgatggtcaaattccaaaaggctgatatagtaagaaaggctgttattttttagagtagcagccttttttattttgaatataaaatatgacacatcctatacttcctaggtgtcacgccatacttctgtttaaacgccttgataaaatggctgcagtcacaaaatcctgtctcctggctgatataagttaggtcaaaatctgtgaattgcaataagtcctccgctttttgcagtcttactgtgagaaccatctccttgcaggtctgcccatagtactccttgaatattgcggcaaaatatgaataactcatatgaaatttttccgccagctccgccaccgagagagcttcctggtagtgctgtgaaatgtactcagatacctctgtaaatttttcgcttaatacagtttcttttttccttttttttatctgaaagccttcctgcttccagacacgaagaatttctgccataagaagacaataattcgaatgcataataatgtcataaccaaattgcttttcttctaacgtcttcactgatccctgaatcagctgcttcaatttttcctgattaaatttctctttcgaaaaataaaccgatagcttctgctccactgctgccatggcgatcagactcgaaatcggtggaagcgccgaaccggatatattcagatgtaccggatcaaatttcagaacatagtagcggattggaagttgtcctgctgaataaattgcatgagccatctgcggataaaatacgattagatctcccggttccaatacataattctcttctcctgcctctacatacgcctttccctccaccatgtaaagaatctccacaaaataatgccaatgtggaagaattggaaacatctcagatgtctgtgcatcaaataaaaaggcttcatatggtttgtttaatttgtctgagcattcaaaataaggtttcacagattatctccatcatagatttttacaattttgtaatagattcattatatcatatcttttttctacatgatatactttcagcagaaaacatccagaaactatataattcgaaagacaggagatttttactaaaatgaaaattcaaaatcaacttggatatattaaaggaattacatttgccccatttcacaaacgtggttctctttctacacagactgcacgtgatagttttgattatatgatagaacacacggctgctgatttcgtaatccttgctcctgtagggctacaggagcacgcacactcagaagagatttgttacacttccagtgccacattctcagatgaagaattaatcaatatgatacgttatgcaaaaagcaagagcatccgtgttgccctgaaacctaccgttaattgtaaaaacggtgtctggcgcgcttacatcagtttctttgaaaaagatgttccatgtgaaccgaaatgggaaaactggtttgcctcttacacagaattccagacatactatgccaaaattgcagaagccgaacaatgtgatctttttattgcaggatgtgagatggtaatgacggaacaccgcagtgaagaatggagaaacgtaatcgctgcgatccgaaactattaccacggacctgtttcctataataccgataaatatcaggaagaaaatgtaacctggtgggattgtgtcgacatgatctcctccagcggatattatccgattgatcagtgggaacaggaacttgaccgtattgaaagggtcgttcagaagttcaagaaaccatttttcttcgctgaagcaggatgcatgtccagaaaaggttcctcaatggtgcctaacaattgggcaaatcagggagctttacgtctggaggaacaaccagactggtatcgagctatgttcgaggcctgcgcaaaacgctcatgggtaaatggttttgccatgtgggaatgggcaccggttcttccttccagaagtactgcggcaagagataccagctacgaaatctgcaacaaaccggtacaggaggttattaaagactactatgggagagacaaaagaaaataacatacaacaaacttcagaacaggatctctggcaggaagaagctgccatgatgcacatcttcagccggaacagaaaaaataacctgcgcacgcttctttctcttttcaagggacattatggcgcgctggctggttccattttctttttcattatcaagcattccccaacctgggttcttccaatcgtcacagctaatattatcaatgcagtgacagaccacaacgggaatattaccaaaattctgattctgaataccatccttatgattgtatttctggtacagaacataccaaccaactacatccatacctggctctatgccaaaacggtacgaacagtagagaaagaactgcgcgaagccctagtctgcaagcttcagcaattgtcgatcacctatcacaaggaaatgcagtccggaaggcttcagtcgaagatcatgcgagatgtagaacagatacaaaatcttgcatctcagatctttatctctcttttgactatcattctgaacattggtgtatccttcggagtggtcatcttcaaaagccggatcgtatttcttttcttcctctgcacgataccggtttctgttttgatcattgttggttttaaaggaaaaatcaaaacccataaccgtgctttccgtaaagaaatggaagaaacttctgcaaaagtaatggaaatggttgaaatgattcctgtaacgaaagctcacgctctggaagatcaggaagcccgtaaaatgagtgaacagcttcgtaaagttgctgaaaaagggcttcagcttgatatgattcagacatacttttcttcaatcagctgggttgcatttcagatctttcaggtattctgtcttgcatttacagcctacattgcatggaaaggaatcatcggtgtcggagatatcaccttataccagacttatttttccagcatcgtcgctcagattgcaggtattgtgactttgctgccaatcattgcgaaaggcctggaatccgttgaatcgattggtgatgtgctttgtgcaaatgatattgaggacaaccgtaggaagaaaaaagtagttgatctgaaaggtgagattacatttcaggatgtatcttttacttataaaggcgatgaaaaaccggtattaagtcatctgaacttcaagattcagccgggggaaacagttgcctttgccggttgttccggctctggaaaaacaacaatcctcaatcttgccatcggtttcctgaaagctgacagcggacaggtattggttgatggaaatgacctgatggaactggatctgcacagctaccgaaagcagattgccgtcgttccacaacagtccattctcttcaccggaactttccgcgagaatatcacctatggatctgaatccatctccgaggaacagttatggaatgtcatccgtgcagccaacctggaagaagttgtccagaaactgcctgatggtctggacacgatgatcacagaacatggggaaaatctttccggcggacaacggcagcgcatctccattgcccgcgcatttttacggaatccgaagatcctgattctggatgaggcaacttctgcgcttgacagcatctctgaaaagaagattcaggattcaatccagaaacttgtgaaaggacgtaccacactgatcgtagcccaccgtctgtctaccattcgcaatgctgaccggattgctgtgattgaaaaaggaaatgttctggaatgtggctcttacgaagaattgatagagaaaaaaggcgcattttatcggatggagaaaatgtaaaaaatcagtagctggttagttcagaaacctgtctgcggaattgatctggaaagagtagaaagaaaatagctggacagatgcagaggcacagagcaacatactaaccttgattaaaaatacttgattttacagtgttttggggatgttacagtagatttttaccaacgatttaccaaagctatttgagtaggggataaattactcaggatcagcccgcatttgaaagaaggtgaccacaacgaaactgtttaagaaaaaaattcccgaacagacttatgataaagccagccaaaagccggtgattaaggcgagcatctgcaacggcgagcagattgccggtttcaaggatcttcatacgggaaagatcgaggaagtgatgctgattaaggggccggcggatttggaacggtttaagaaaatgtatggcattgaggatgagatcggaaaggagtattgatatggcgaaaaggaattgcgggaactaaacgaggagtattgcagctgggagtacatggaagtgtcggaagattacagataaaaagtatggacagccggaatatggagtaccggacataagacagagcgcggcagggacagctgcgcatggcagaaggtaagagaagggaagactgccggcggaacatgcagagaggacagggatacgggatgaacagtatttttcacagaatcagcgttagaaaatatcagaacagggacgtggagcaggagaaaatcgagctgatgttaaaagcggcgatggctgctccgtccgcatgtaatcagcagccgtgggaattttatgtggtgaaggacaaggcggtgatcgagcggctgtcagaggcgtcgccctatgcaaaatgtgcgaaggacgcgccggtcgtgtttgtgccgtgcttccggtctaaggggattgcgccggaatattttaatatcgatatgagcgcggcggtggagaaccttctgctggaggcggacgagcttgggcttggcgcggtctggatgggaatttcgccggacgaaggcagaatgaaagcggtgcaggaagtgctggatattcccgaggatcttcatgcatttgcgctggttccctgcggttacccggcagaggagagagcgcaggaagaccggtatgaggagagcagagtgcactatattatgaactgataagccaatattccgagagcagaaggttggcaaacaaagatatcacattataaaaacggggcggcagggaagcgtttctctgccgccccgttttcgtatatttatgaaaaataagagggagaacaagccccctgcttgccgacgctttagcggtgcagctcctgacagcgtttccggtactcggacggtgtaacatccgcgacttcccggaagacccggttaaaatgtgtcagattggaaaacccggtttctctggcgacttcggtgacattccggtccgtttccatgaagagccgcttggcgttcatgatgcgggtctgcttgatatactccacgatcgtgcgcttggtacttttcttgaattcccggcagaggtaatattcgctgacataaaaacgctcggagaggtccttgagtgtgatatcttctgcataatggttatggatatactgaatcactttggtaacccgggtctcgcggaggatgccggtgctctcctgattcatgcgcagaagctgcaccataatcaggttcaaaagagactgcatacattcgtcgtggcagtccagatgcgaatgctgctcctcttccatggcatagatgatgcgccgcagctggtgaagctcctgactgtcaggacggtaaaccacctgcgagtggagaagcttatgaagaagatccgccgaggtgatcgttttcgggcggaaatacagcaccacccgcgaaaatgccatatcctggtcaccgtaggaacggtgcatcgtctgtggagggaagagaatacagtccccggcctgaagcttgaagagcttgtcatccatcagatgatagcgctccccgctgtcgagaaaatacagctcaaaataatcgtgatagtgagactgtgacatattgtcattgacgccagttacctgggcgatggcgcaggctgcaccggctgccatacttgtctgtgcaacatcaatcataaggcacctcatagaaaataaaaaactctgtttctatggaaattataaagcaaaaacgcaacaagtgcaagatatgtaaaaaaaagtgcgattttgaacaaagtctgtatagttattgaacctgagtttttgtaagatgatgacagaaggaaaacagatctgaatgaaccggatatagacaataagaaaaagagttacaaaaccaaaggaggaaaactcgtgaaagtatgttacaaagcaggtgctgtcacagcacagaatcattattattcgattgctgcagatgcagtggagattcgtgtatggttccttacggatgatatcatccgtatccgggcgggctttgacggagactgggatgaagcatcctacagtctggtaacaaccgcgtgggaatcccgcacagatgaactgatgaaggattaccggaagcggattaacgtagcggaagctgcactggtggatggtgagaccagggcagtgattaccggaaagaagctccgtgtggaagtggaaaaagatccattccgtatctgtgtctatgatgcagaaggaaccatgcttcatgcggatattccggagcttgcgtaccgtgaggattctaacaggcgccgcattcataccagccagatcgaggatgacgattatttttacggatttggtgaaaaaggcggcgagatcaataaagcagaaaaatatatgaacatggctcccggagatgcgatgggatacaatgcgaaggagacagattccctgtacaagcatattccgttctatatcaagctgcagcgcagcacgaaaaaagctgtaggatatttctaccacagcacggcagaatgtgacttcaatatgggacgcgagaagcggaattactggcatcgttattcttccttccgtgcagatgccggcgatgtggatttattcctgatcgcgggaccgtcgatcggggaggtcgttgagcgctacaccgatctgacaggaaagtccattcttcttccgaaggctgcattcggatatctgggatcgtcgatgtactatccggaactgccggagaactgtgacgatgcaattctggaattcattgacaccaccagggaagagggcattccggtggatggtttccagctttcttccggatattgtgccgttgagacagagcagggcatcaagagatgcagctttacctggaattataaaagattcaaggacccggcggactggtttgcaaagatgaagcaggcgggcatcgttgtctcaccgaatgtaaagccgggaatgcttctcgttcatccgcttttggaggagatgaaggaaaagaagatgttcgtcctcgacagcacaacggatgagccgggaatcggtacatggtggggtggaaccggaattttcgtcgactttaccaaagaagagaaccgcaagaactggaaagagtatctgaagcagggtctgatccagtatggctgcgagtctgtatggaacgataactgtgaatacgattccatggtagacaaggatgccagagtatattttgagggaaaaggcagcacgatcggtacgatgaagccggttatgagcaacctgatgtgccagctgtccaatgaagcggtaacggagtacaatccatcggttcgcccgttttccgtgtgccggtccggacatgccggaatccagcgatacgcacaggtgtgggcaggcgataacctgacctgctgggatacgttaaaatacaatatcgcaaccattctcggaatgggactctccggagtcgcaaaccacggctgcgatgtcggaggtttctatggtgtttctccggaaccggagcttttcgtccgctgggtgcagaacggtatctttatgccgagattttccatccactcgaccaacaccgacaatacggtaacggaaccgtggatgtacacggacaagaagcagtatatccgggacgcaatcaagttccgctaccgcatgattccgtatctgtattctctggagagcagagcgcatgagaccggtcttccgattatggagccgatgtttatggcatttcagaatgacccgaagacctacaatgaaggcgtagattttatgtggggcgattcactcctggtagctaatgttgtggaaaaaggagcaaagaccagaagcatttacctgccgcagacgggggatgagaacgttcgtttctatgatttttataccagagaagagtatgcgcagggacagacgatcgaggtgccggtcgatatcagttccatcccgctttacatcaagagcggtgcgattattccgatggcggagaatcagatctacaacctgatgcatgagacggtaaccggacttcatattcttatggcgccggacgtagattctgaatttaccgtatatgacgatgacggaaagaccaatgagtaccagaacggggcatatcttaagacccatattaaagtgacggcaggagtcagaacctgtgtggacttcacttatgaaggaaattatgagaataccgtggacacgatgtatctggatgtggtacacagggaaaaagcgccgttctatgttcagattgacggtgtggaagttccgcattttcttcacagacgcaaatttgaagaggcgcagaccggctggtattacagccagagcttaaagtcggtacaggtgaagtacccgaatccgaaaaaggatcatcatgtgatgatttcctttgaggtattcgatatgattggaatgtaatttaaattagaataaaaaaggaaaaggagaacaaaagcaatgaaaaagaacatcgccctcattttggcggcagcgctcgttctgccgaccgtaattgcggcaggcggctgtggcgcaaactccggagtttccagcagtgcagaggcaacggcagagaatccgatggtattgactctggcacacggtctttccgagacgcacaccgtacatattgccatgacgcagtttgcggatgaggtaaaagagaagaccgacggacgcatcattatcaacattttcccgaacggacagcttggttctgagacagagaacttagagcagttgcaggcaggcgtaatcgcaatgaccaaggtttccgcaccgggtcttgccacctataacgaagcttacaatacgttcggccttccgtacattttcaatgataccgaagacttctacgacattatggattctgaggacatgcaggatttcttcctttcctccgaggaagacggatttgtgacgattacctactttacgtccggcgcccgttccttctacaccaaagacaaggcaatccgtgtgccggaagatttaaagggattaaaaatccgtgtacaggatatgaagtcacagacggatatgctgacagcgcttggcggaactccggtggcaatgtcctatggtgatgtttataccgctctttccaccggcattatcgatggtaccgagaacaacgagacggcattgaccacaggtaagcacggcgaggtctgcaaggtgtactctgttgaccagcacgcgatgattcctgacgtgatggtcatgtcagcaaaagtatggaacaatattgctccggaggatcaggaaatcatcctgcagtgtgcgcacgatgcgaccgaatggcacaaggaagcatgggatcaggctgtggatgaagcaattacggaagcggaagatatgggtgtggaatttgtctacgatgtagataaggaagctttccgtgaagcgacggcgggaatgatcgatgaataccgcgaagaatatccgggagttgcggatttgctggatagaattgatggaatcagagaagaggaggagtaaaaaatggctaagaccttaggcacgattaagaaatatatgaacaaagttctcgcggcttgctgcgcagtccttctgacgttcatgaccttcctggtattgtggcaggtattcaccagatacgtcctcaacagcccggcggcatttaccgaggaactggtaaagtactcgctgatctggaccggctttatcggcgcggcctatgcattttccaccagagagcatatggcactgaccctggtaagagataaactgactggaagaccgcatcagattctggttatcttcattgatgcgctgattctactccttgcaatctttgtaatcacgattggcggttataagctggcagtgtctgcaagggcggaattctccgcacttctgggagttccgagaacgctggtatattccatcgcaccgatttccggcatctttatcatcatcgcacagattattaatctctacgaagacattaccggaaacaaagtagaagaataaggagggaaaaaatgaatatcgtactaacaactatcattttgtttgtcgttttcggcgtactgctgttcatgggtgttccgatttctgtaagtattattgtatcttccatcgtaactgcaatgtctaccctttcctgggatcagattacgtttattaccatgcagaagatgaattccggtatcgaaagtttttccctgctggcggttccgctgttcatcctcgccggtaacatcatgaacaatggcggtatcgcaaagagacttgtcaattttgcacagctttttgtgggaaaacttccgggaaacctggcacaggccaatatccttggaaacatgctttttggagcgctctccggttcttccgtagcggctgcatctgcaatgggcggatgtatcagtccgattgaaaaagagcaggagtatgatccggcttactcggcggcagccaacattgcttccgcaccgaccggacttctgattcctccgacctctgcattcatcgtttactctaccgtagccggcggcgtatccatttccacgctgttcatggctggatatgttccgggtatcctcatgggactcggctgtatggtggttgcgttcatctatgcgaaaaaaatgggcatcaaggcgaccggccgtgacaaatccatcagtgttgcaaagacgatctgggatgccattccgtccctgctgctgatcattatcgttatcggcggtatcgtatccggcatctttactgcaacagaaggtgcaggtattgcagttctttactgcctcatcctgtccatcatctacaagagtatcgatttcaagggatttatggagattctcctgaactctgccaagacttccggaatcatcctgtttttgatttctgcttcttccgcgatgtcattcgtgatggcttattccggaatcccggcagcaatcagcagcgcgctgctctcggtatccacaaacaaatatgtcatcttcattctgatgaacgttattctgctgatcatcggtatgttcatggacatcacaccggcaatcttgatttttacaccgatcttcctgccgattgcacagagctttggcatgagcgacatccagtttggcgtaatgctaattttcaatatgtgccttggaaatatcacaccgccggtaggctccgtactttttgtcggatgcggtatcggacatgtatcgattgaggaagtaacaccgaagcttattccatatttcctggtactgattgtgatgcttcttctggtaacctttgtaccgggactctccctcggagttcctagcctcatgggattagtctaaggatagacctgtggaattgccgcaataagcatagaacttctttgctttgataagtaatattatcaaaagaccacaccgtgggatttcagatggaaatgcggatggatattcggttcaaaaaatgtggcatttctaaccagccgaatgtttgcatccttgatgatccgtgtctttccaagtttggagcactccacggactgtgtccgcaaatcatgagacaatttaagaactttcgtgtggcgcttttgccgctgctgaataaaacataatcgcgcgaagccgatgtctgagttgccatctgccttatcttcaatagcagatggcaatgagtttcggttcgcgcgattttataatgtctatgaagcagcggcattagccgccactagaaagttcgcccattgtctctgatttgtcggacacactccgggagtgttcaaacgtggaagagacacggaatccgatgcaaacattcagctggaagaaatgttcacatttttctccaacgaatattccatctgcatttccacatgaaattcccaagtgcgtttctcataatattacttatcaaagcaaagagcgatatgcctattgcgacagttcctttgtgtaagaggttatcttacaaagagatatgccgtgtaggcgacgtataataacacgcagacggcgccctccgcacggctcatggaccgtttggttctcgcgaaaacaaacagcaggataccgctgcagagcagcaggacgcagtcgatcactgattcgccgagcacatgaagcggcgagatggcagcggacatgccgaggataaacaagatattgaagagatttgatccgaccgcattgccgagcgccagcccgctgtctccttttctggttgccacaatcgaggtgacgagttctggcagggaagtgccgatggcgatgatggtcaatccgataaaattctggctgacaccgaagtttgcggcgatgatgcaggcgttgtcgacgaccagatcgccaccgaagatgacagcggcaagtccgccacccataaagaggatacttttcggaagcggtaataccttacagacctcgccttcctcacggttgcgcagggcggaacggatcatgcatgtgatgtagagaaccattcctgccagaagaagaaaaccttcgacgcggccgagcgttccgtcgagaaacatgaggcacagaatcagcgtgaccagaatattgacaggcatgtcccgctttaagatctccgcgttcgtctgaaagccggacaaaaaggcgcagattccgaccacaaccagaccgttgaatatattcgatccgacgacattgctgatggcaatatcgttgctgccgccaagcgccgcgttgatgctgacggacgcctccggagcgctggttcccatggcaacgatcgtaagaccgatgatgacgctgggcacctttaagattttggcgagcgaagaacttccctccacaaagaaatccgcgcccttaactaagagtacaaaaccgatgagtaacaatacatattccatacgtgttcctttcctgcgacaaagaaatgggtataaaaaaagacctttatcgcatcaaaaatgagtgataaaagtctcgttacttacaataataaccggccttgcggcgtgatgacgattattatttcagcttctgcgcgcagcgtctggcgcatccgaagatgaaaactactcccttttattaaggctattttaggacggggcaaaaaagatgtcaataaaaatgtcgctatttgtcgaaatccaaacgaaatccaagcggaagccaggtggaatctgcatgaaatccgaacgaaatccaagcggaacccgggcggaacccacatgaaatccaggcgcaatgagcgcggtatatcatccggacggttttgcaagattatcgttgtaacaatcgatagatatgtctataataacagataacaaacggcaagagaacggagcgtgaggacacatgttttttattatgggaattacggacggcagaaaagattttgattttcaccagatgatgacctgcgatgcctgcggagcttacggcagatatcaggtgttcatgacatacaccgtattttcgcttttctttatcccctgcataaaatggaacagacactactatgtgcaggcgagctgctgcaatgcgctctatgagctggacgcggagattggaaaacggattgcgcgcggcggggatgtcgagattctgccacaacatttgcgtccggtgcatccggggaatcgtggaaacggctggaataccacaaaacagtgcagaaattgtggttttacgacgacggaggattatgaattctgcccgaaatgcggtctgcggttttaacagcggcgcgggatgcggaatagaaagaggttacaaaggagagaacaatggagacatggtattatgaagtggtctcgatcgatggagattacgcgaacttaagaagaacggatatcccgtcagaagatctgaagcttgtggcgcgggcactgcttccggcggagattatggagggaagcagattgaaatacgagctgatgcagtacgagattgtggaagcatcggtcggctgaggaacgacgatcgatgtggaaccggtgcacgagatgcaaaaagtgttgtttgcggcggatgagctgaccgggctgatctgggcggcggcgctgcaatgagcagatgataagccactatgcagggtgggaaaagcagattgttttcggaaattcgctgcaaacaccttgacagttctgattttttgaaatagaatctaaagcagcgcgaagaagagaagagtaccagtgcggcaccctacagagagagatgcatacggtggaagcatcttggaagaaagccctggaaagaccacctctgagcggccctaatccggtccggtgattccgttatcatcaaacgagtgatttcccgacagtgggatgcgtgatccgaggggatccggcagtccggcatggttttacgggaataagcagggtggaaccgcggatacagtatattcgtccctcatacaggcacaggtctgtatgggggatttttttcgtccggaaaaagcacccggacgcagaacaaggaggaagaaaatggtagattttaaagcagatgagagactgaacacactcaatcattcctgcgcgcatgtaatggcacaggcagtcaagcacttatacccggaagcaaagttctgggtaggcccggtcgtaaaggaaggattttattatgatatcgatcttggcgataacgcagtcaacgacgacgtgatcgcggcgatcgaaaaagagatgaagaagatctgcaaagagggcaagaagatctacagacgtgagatctcaaaggcagaggcattagagctttttaagaacgacgagtacaagctggatctgatcagcgatctggaggacggaacgatctccgtctacgaccagggcgattttacagatctttgccgcggaccgcacgtggacaatacaaagctctgcaagaatttcaagctggtaaaatattccggcgtgtactggaagggcgatgcgaacaaccacgtgatgcagcgtatttacggtgtatgtttcccgacagccgaggagctggaggcacatctgaagcttttggaggaggcaaaggagcgcgatcacagaaagatcggcaaggagatgcagctgtttatgtccgacgatctggtaggacgcggactgccgatgttccttccgaagggctataccgtatggcaggagcttgagaattacatcaaggcaaaagagagaaaactcggctatctgcacgttatgacgccgtgtgtcggcacggttggtctgtacaagacttccggtcactgggatcactataaggagaacatgttcccggcaatggaggtggagggagagtccttcgttctgcgtccgatgaactgtccgcatcacatgatgatctatgcaaacagaatgcattcctacaaagatctgccgatccgtatcggtgagatcgcacacgacttccgtttcgaggcgagcggtacgttaaagggtattgagagaggaagacatttctgccagaacgacgcgcacctgttcgtgacaccggagcagattgagtctgagttcgccagcgtggtggctctgatttttgacacctacaaagacttcaatatcaccgattaccgctgtgtactgtccttaagagacccggcggacaaggtgaaatatcacgacgacgacgctatgtgggatatggcggagaatgcactccgaaaggtattaaatgatatcggcatcgagtatacagaggagatcggcgaggcggcattctacggcccgaagctggatgtcaacgtaaaaccggcaatcggcaacgagtacacactttctacctgccagctggatttctgcctgccggcgaagttcaacttgacctacattgacagtgacggaacgaagaagactccggttgttcttcacagagcaatccttggttccctggatcgtttcatggcttacattctggaggagacgaaaggcaacctgccgctctggctcgcaccggtacaggcaaagatccttccggtcaagaatgaggatgaggagttgaatgcatattctcatgaggtatacaaataccttgaggataacggaatccgtgtggagatcgatgagagaaacgagaagctgggctatcggatcagagaggcacagatggaaaaagttccgtatcttctggttctcggcaagaacgaagtggcagaccggacggtaagctacagacttcacggagagcagcagtctacgacggtatccatggaagacttcctcgccatgttgcaggaggatatccgcacgaagaaactgaatccggctgccgcaaaataaagaacgatacggcgtagtgttgaacttgtgttgatttaatagtataatcactacgatcaataatataagaataagtgcaagaatagataggaggaatctattatggttacctggaacaacttggatacccttgcttctttcaaggagctttccgaagtggaacgtgtgaatcttgtcgaggcaatgtccggagagaacggtgctgaccgtgtgaagaattacagtgtgccgatggctggcggattttcttacaactatgcagccaagcaggtggatgataaggtgcttgcagcacttgtaaagctggctgaggaagcacagcttgcggagaagtttgaggcactttacaatggtgaggtgatcaacaccggtgagaagcgtctggtgcttcatcacatgacacgcggacagctcggtgatgctgtgacggcagacggtgtggataagcgtagcttctatgtagagcagcaggagagaatcgctgattttgccaacaaggtacattccggcgagatcaccaatgcggcaggagaaaagttcacaacagttgttcagatcggtatcggtggtagtgacctcggtccgcgtgcgatgtatctggcacttgagaactgggcgaagaaaaacggcaagttcaagatggaggcaaagttcatcagcaatgtagacccggatgatgctgcagcagtgctgaattccaccgatgtggcgcatgccattttcgtactggtatccaagtctggtacgacactggagaccctgacgaacgagtccttcgtaaaagatgcgttaaagaaagcgggactggatccttccaagcatatgattgctgtaacgagcgagacatccccgctggcaaagagtgatgattaccttgcggcattctttatggatgactatatcggaggacgtttctcctctacttccgcagtcggcggtgccgtattatccctggcgttcggaccggaagtgttcgcacagttcctcgagggagctgctgcagaggatcagctttccgcaaacaaagacgtattgaagaacccggagatgctcgatgcactgattggcgtttacgagcgcaacgtactgggctatccggcaacggcagtgcttccttactcacaggcactcagccgcttcccggcacatttacagcagcttgatatggagtccaacggtaagtcggtgaaccgtttcggtgagccggtagactacccgacaggaccggtgatcttcggcgagcctggcacgaacggacagcattcgttctaccagctgctgcatcagggcacagacatcgtaccgcttcagtttgtcggctttaagaacagccagatcggcacagatgttgtgatccaggacagcacaagccagcagaagctttgcgcaaatgtcgcagctcagatcgtggcattcgcatgcggcaaatccgacgagaaccgcaacaagaatttcgagggtggacgtccatccagcatcatcatcggtgagcaggtgaacccgcagtctctcggagcacttctggcacactttgagaacaagatcatgttccagggcttcctgtggaatgtgaacagcttcgaccaggaaggcgtacagcttggaaaggttctggcaaagcgcgtgcttgcacatgagaccgacggcgccctgaaggtattcagcgatctgttaaacatttaatataacgaaaaagaactgtgtcacgtcctgcggcagatgcgcggcgtacacagttctttttttgtgcgttgggaagggcggacggcatggcagtattgcaggaatagcggcagtgcaattctttggagcaaaatttcagaagttcttcggatgcgtcaacggcatccggtttgctgtctcttttggcgttcgactgcgcgccgcgggtgtccgcaggcaacggacaaagcgtcggctttctagtctcgctaggcagaccgcttcacaaagtcccgatcagaccgcgcaatccgaaactcggtgtctgcccgcatttaaaacacggcggcagacacctcagacagtcgtttgcgcggtccggttttactcatcggtctgccaagcgagacacaaaagccgtcgaaaatgtccgattgcccgcgaacatccgtggtgcactgtcgaacctcaaaaagacaggaatcatcgcagatgccgttgacgcgtccgatagaactgcggaattttgcgacagaatgcgctgccgcgatttcctgcaatatgcacaagccgtcataacgacaaaagaaaaagaaccgtgtacgccggggcactgccgctggatggacacgattctttttctttataaaaatgtttttaagatctggaggactccattctcccagtagggcgcacaggtatcttttgccgcggcgatgacttccgccctggcgttggcgacggcgtaactcctgccggcgttctgcagcatctcgatgtcgttcaggttatccccgaacgtgcaggtctcttccggtgaaatgccgaaatgcttctgcacgaactcgatcgcggttcccttgttcgcaccgagcggattgcagtccatccactctttgccggcggcggcaagctgtgccttgtccttccatgccggggtgaagagcggcgcacacatttcctcacaggcagatttgtggtagacggtgaacttgatgatatcctgctccgggatgtcagatagacgctctgcctcccggatatcgtagccgtaggaatcgcgcagccagtggaacatgcggcttccggcgtcttcggcgagacagtagtccggtgtggcgacaaaacagtcgcagtgcggcatctgttcctgcaccatgcggcacatgccgctccagacgtcgcgcggcatcgtgtgaaccatcagaatctcctgcggggtgcgcacgaccgtgccgccgtccgtgatgtagagcagctgatctttgatcggtgcaaacagcttccgctcactgatgaactgtctgccggagcagacggcaaaaatgattcctttctggacaagttccttaatgacagtcatgtattcgggatcgatctgcatcgttccgtcttttaccagtgtcccgtcgacatcggtggcaatcagttttatcatgggattctccgttccggggctgatgtgcgccctgttctgtaaatgtttctggatacaacagctgtattataacgtcgggaaacatattttgcaaatatcaacggttgtaaaatgtgcggcaatcaattacaattttatctgggtcatcttaggatgacatacacgaaagaaacagggcatttccggaaaagcggggaatgacttgataaggagagaaacatggcggttggattatgtcacagcgacaaaaaggcggtctgcagaaatctgcagtacagtgagaatgtaaatatgccggacagccccggatggaaatgggtgcagacggtacagacggaagcggcggatcgttatctgatccggctcaaaagcagggaggaaggaagagcgcgcaagacgtaccgcgtggaagtgaaggaagatacagtggatgcaaagagtgcgcccaatgtgacacagattgtgcttctgctactgttgcttccgctgttggggattatttttgcgggactccgctacagcttaacctcgttaaatccgcaggacgatctgcagctggtgctgatacttaccgtgattgccgcgatacttgggcttagaatctggctgatacagcggaaggcggataaaacgctccgctattttctcatgacgcggatcatcaatgcgccgggaaataggaacggggcatatgcgggtgccgcgcagcgcacagcaaaccagacctggagacggacggcatatgcagaagacgcggcatatgccggggacgcagcatacgcaggagaagacattgccggttcggtggagatggaagaaccggaagagcgggtctgggtggcggagtggcacttgtcggaggcgtaccggcgttacagccgcctgcaggcaatcccacttgcggcacttgcactggggggaatcatatttttgtacgcgattgcgtaccggtttaacacgtcccatgacactgcacgcacgatgcttctgatgggagaggcggggctttatatgacattgctcgcccttttgagcaaggtgatgcagtaccgctatctgaagaaagcaaaagcgcaggcaaagcgttatcacgccagaattgcccgcgtcataacaaccgggaaaaatggcgcgaccaaatattatctgtatgagttcatggatgaactggggcgaaagtgcgaggcgcgtgccatgtatccggtacggcaggcaaatgtgggaaatgtgcaggatatggttggcggaaaagcagatatctggtttgatggtgcgcatcttccatatgcattttcagaaaaagacggagcgccggatatccagatgaagcttcggaatctgattgcgggtactgtggcggcagtggttgtgatcgcgctcatgtttgtgtatgcaggaaaccactatgtggcttacaaccaggatgccgacagtctgctgatctcttatgattcccaaaaggcggagtcggatctgacgtttgaggacgtgaaggacgacccgactgtgcgctggatcatagatgcttacgcgatctatgtaccgtttgagaacggagaatatggcgaactgggcggtcattctagagaagactgggatcaggagcaggtgaaggaatatctgtctgactggtggggcattacgagccgggcaacggcgacccgcacgatcagccagatgctgaaaaaaggaaccagagcgtcttaccgtcatgcgtttgaaacttacctgaaaaaagggtatctgtcgatggatgaggatggctatgtcgatattataagcatcagtgagatcccggaggatgagcagtgccggacatgggtatgctatgatgcgtatggacatctggacacgcgcggtgtggatgcttgggattatgtccgtattatgcgcatcacgggactgtgctatcagtgcggctacatcagcctcgaggagtgcctcgaccagtgtctgccgattgcgcagagactgcagaaggaatatggaagctttgaggagatttttgaaagctacatctatggatatcaattctggaaaaatgacagcgatgacgacaggatctatttttaccggagggcggcgggagaagccgtcgaaaatattcagtcggagtacaatacagaactggtaaaagactgggagtaggagagaaggatggaacaggagacacagacaccgcacaagcggcgggtgcgttacaagggaaaatacccgaagaagtttgaggaaaaatataaggaactgcagccggagaaatatcaggatacgatcgagcatgtgatccggaagggaaatacgccggcgggaatgcatatctcgattatggtaaaagaaattctggactttttgcagattgagcccggagagcagggatttgatgcgacgctcggctacggcgggcacacgcgtgccatgctggaatgtctgaaaggacagggacatatctgggcgaccgatgtggacccggaggagtccgccaagacgaaaaagcgtctggaggatctgggattcggggaggatcttttgacggtgcgccttcagaatttctgcacgatcgatgagatcgcaaaagaggtcggcggcttcgactttattctggcggatcttggcgtgtcgtccatgcagatcgacaatccgaagcgcggcttctcgtttaaggtggatggaccgctggatctcaggctcaatcaggagacggggatcagcgcggcggagcggctggatacgatcacgcgggaggaacttgccgggatgctctatgagaactccgacgagccgtactgtgaggagctggcaaaagcgatcacggacgagatccgcaggggcagccgcatcgacacgacgacaaagctgcgcagggtgatcgaggatacgctggattttctgccggagaaggagaaaaaggacacaatcaaaaagacctgccaacgcacattccaggcactgcgcatcgatgtgaaccaggagtttgaggtgctgtatgaattcatggaaaagcttccgggagcattaagaccgggcgggcgcgtggcaattctcaccttccactcgggggaggacaagcttgtgaagcaggcgctcaaagagggatataagagtggtatttacagtgactatgcgaaggacgtcatccgtccgtcggcgcaggagtgcgccgcgaatggaagggcgcgttccaccaaaatgcgctgggcagtcaaggcgtgaaaaaagagaatatatcacaagttttatttttaagagggagaagcgattatgtgtacagcagcaacctatcggacgaaggatttttattttggaagaacactggattatgaattttcctacggtgaggagatcgtcatcacaccgcggaattatgaatttcacttccggcatatgggacaggcagaggagcattatgccatcatcggcatggcgcatgtggcaggggattatccgctgtattatgatgccatcaacgagaaggggatcggcatggcaggtctgaacttcgttggaaatgccgtctacgcagaggtgactgagggaaaagagaatgtggcttcatttgagttcatcccgtgggtgctccgccaatgcgcgacgatggatgaggtgcgggcgctccttgcaaaaataaatctggtcggaaccccgttcgccgagcagttcccggcgtcacagctgcactggatcatcgcagacgaaaatgaggcaatcacggtggagtcggtggcggatggtctgcacgtctacgagaatccggtgggcgttcttacgaacaatccaccgtttgcacagcagatgtttatgctcaacaactatatcggactgtccccgaagcagccggagaattctttcgcaaaagatgttccgcttaacacttacagccgcggaatgggtgcgttgggacttccgggagatctctcttccgcgtcccgttttgcgcgtgtggcgttcacgaggatgaatgccgtttccggcgattcggaggcggagagcgtcagccagtttttccatattttagggtcggtggatcagcagagaggctgctgtgaagtggcggaaggaaaatacgagattacgatttatacgtcctgctgtaatgcgaccagaggaatctactattacacgacctatgacaatcaccggatcatgggcgtggacatgcatgcggaagatctcgacggaacaacgctcacctgctatccgatgatcgcggaaggtcaggtgagctggcagaacggacagaattaagactgcggtgagaaaaatgcgacggcgatggcgccgggaccgacatgggttccgatcgtcgcaccgagggagcagaccgggagctggtccgtgtgtccgctccagagtgcttcgctgtctttgatatatttttgcagcatctcatcgctgagtccggtgtaaccgaggcagaaggggcgggtaaaatcgattccgtctgccttttctatttccttcatgagaaaattattcccgtttttggagccacgcgccttgccgagcatgatgatctcgccttccgatacggcaacgaccggcttgatcgccatggcgccgccgagaaatgcggtggcggcggagatgcggccgccttttttcaaatattccagcgtatccaggacaccgagagtgtggatctgctccttggaggcttctaagattccgacaatttctttggctgataatccctgatcttttaacagaagcgcatacttgaccagaatgccctcgccgatggtggcgttatagctgtcgatgacaaaaacttttcctgcaaaatcttctgctgcgatcgtggcactctggtaagtgccggagagacggccagagatcgtgattgcaatgacggtctccccgtccgccaccgccctggcatatacctcttcaaaagcggcgggggataccaggctggtcgtgggaagagtgtcgctctcaatcagcttttcgtagaattcgtgatggctgattgtgacgccgtcgaggtattccgtatcgccgaagcggatcgcaagcggcagaatggtgaggtcttctctggtagaagcagagagatcggatgctgagtctgtgataattctgattttttccataagattctccatatatttttatttttgctgactgtgttcggtcagatagtcagacaggttttcactgatgattgcaagagtgccatagaaatcgcggcgcctttcctccgtcagcccgcgtccaccgtaggagagcgcttctttgatgcgtgtctggatgccgcttacaacggagcgcccttgaacggtaagcatgtagtgcgaccggtaggatcgcttgtgatcttccggctgttcgcagacgacaagctgccggtcgctaagctgtgagagacagcgggagacggcggctttgtcctccttgcagagttctgtgagctgcgttgcggtcagcccctccgggtgttgtccaaggtaatagagacacatggtgtgactggccttcagcccgaactgcttcatttccagctctttgattttctgtaagtaccggttcaactccaggatggagagtgaaaaggtttcaaaacgatgatccatgggcgctcctttgcaagatgttgataaatcaatatctcggattatagcgcaaagatgttgataagtcaacatctttgcgtgaagatataaatgggatagttgcggaaggataacagaaatgtaaagagtggatatgaaaaaaatatgatataatgttcgcgaaggcaaaagtgagcatggaataaagacggacgtgcatgcttgcatgtgtcggacggatatgttccatgtgaacgcgcccgcgggtccgggaaaccagaggttttccggacttttgccgaagcaaagacgcatatgatataatgcttgtaatagcacaataaaatgatatacaagcggcaaacagaaaaggagcacttttatgcagatcagacatgcaggtacacaggacattccggggattgaccggctcctgtcacaggtattaacggttcatcataacggacggccggatttattccgggcaaatgccagaaaatacaacgatgacgaattaaaggaaattttagaggatacgacgcgcccgatttttgttgcggatgacggagcgggcaatatcttaggctacgcattctgcgttttccagcagcacatcaatgacaatatcttaacggacatcaagagcctctatattgacgatctgtgtgtggatgagaactgcagaggacagcatatcgggcagcagttgtaccggtatgtgctggattatgcgaaggcgtccggctgttacaatgtgaccctcaatgtctgggcatgtaatgaaaatgcgcggaagttctacgagaagtgcgggctcgtgccgcagaagatcgggatggaaaagatactgtaatccgggagacaggaggaaaatatgggattttttatagcgatgtttttatgtaatctattgatgccttctattatggtgatagcgggttactgtatgtacaaaaatcctccaaaagagataaacgggctgatcggctatagaactgccatgtccgaaaagaataaggatacctgggcatttgcgcatgactgttgcggaaagttatggatcaaatcaggcatcatattgctggtgccgacggttctcgctcaaatcccgtttgcaaaatcgggtgaagatgtagtagggacagtaacgcttgtcatcgaagcggttcaggttttggttctgattggttctgttattcttgtggaaaaagcgttgaagcgcacgtttgacgaaaatggcaacaggcgcggatagagtaagagacgcagctgaaagaggggggagatatatgaaagcagatgaagtgataagccgggttgcggatctttgcagagagcatggtgcgaaaaaagtgattttatatggatcgcgggcaaaagggacagccggggaacgcagtgacatagatattgcggtgtccggcggggctgattttgatgagctgcttgaaaaagtcgaagaactgccgaccttgtacagtgttgatttattaaatatggatacctgtaggaatgatttattgatggaggatataaaacaatatggacgcgaaatttgacagacggtttcaatcattttgcaattcgctggatgctttggcggaggccagggaaagagatcttacggattcctttgtattaagcggaaccagtgcaaaatttagtattacttttgatttatcgtggaaggtaatgaaggacatattggtacagtattatgcaataacaggattcgttacaggttctccaagggatgttctgcgtgaagcatttaaggcaaacttgatttcggatgatacatggatggacatgctcaaagtaagaaatgaactcgcacatgattacgatagtgagattgtgaaaacatattgtaacacaattgtgaaagagtatattgcttcccagccggatcatattttgtcaatattatgagagggtaattagaagatgtacatatttttgctaatcttaatttatatcgcttttatcagcctgggcttaccggattcacttctgggatccggctggccggtgatgcataccgaactcggcgtgccggtgtcctatatgggcatcgtatctatggttatctctggcggaacaattatctcgagtcttctttctgataagctgaccagaaaattcggcacgagaatcgtaaccgttgccagtgtttttcttacggtcattgcgctgttcggcttttccttttccagccggttctggatgctgattgtttttgctgttccttacgggttgggagcgggagccattgacgcagcacttaacaactatatcgcgcttcattataaagcgaagcatatgagctggctgcattgcttctggggcgtcggtaccatcgtcagtccgttcattatgagctatgcattggcaaacaggacatggaacagcggttatcgcatggttgggctgatacagcttggcattgcactgcttctgcttgttactctgccggtatggaatgtgaaccagagtacatcccgggaggacggaaaaagtgtaggtctaaccggtgcgcttaagatcaagggggttccgtttcttttgcttggatttttcgcttactgtgctgcagaagctacgactatgcagtgggcaagtacctattttgttgaggtaaaagggattgctgcagatcgtgcggccggttttgccgcgctgttctatatagggattactgccggaagattcatcagcggaatcattaccgatcggcttggcgaccgtaaaatgattttgctgggaaccggtattcttgtctgcgggatttttatcctgtgccttccggtgaagtcctatacggtcgcgtttgcagcttttcttgtgataggtctggggtgtgcgcctatttacccgtgcattatccattccacaccatataatttcggggcggaaaattcgggagcgattattggaatccagatggcaagcgcttatgtcggttcgacgtttattccgccgctgttcggactcctcggcaatgcggtatctttttccatcctgccggtctatctgctggggtttgttgtcctgatgattacgatggtggagacaacattccgcatcacccgcaaggaaaaagttgtaaaaatataacagatgtgtatgatagaaatcagagagtcacacacaaccaatttaaggaggaagaaaaatggcaaaggaccagagatttgaaaaggtttattcccagggaacgatgacgaccacggaaatctgggtggacaaggaaactggcgtgaattatgtgtttcacgcaagcggatatgcgggaggaatgacgccgcttctggaccgcgacggaaagccggtcatttcgccggtgataaatgaataaaaaggaactgccgcaataagcataccgtgctttgctttgataagtaatattataagaagaccagagaacaaaaaagttccagaataaacagacggcggcaaattctttgaagcaaaattcgtgtatttcttccatgccgtggctggcatcccgttccgtgtcttggccatgtttggacactcacggagtgtgtccgacaagccgcagacaatgagcggactttctggtgtccctaatggcacctcttcacagacaatataaaactgcgcgaaccgaactcgccggcatctgctattgaaaatagggcagatgccgactcagacagcggcttcgcgcggttatgttttgttcgacataaagatggcatttatgccatctgttgtctggtgccgcaagggacacacacaaaagtcctaaaattgtctgctggcttgcggacacagtccgtggagtgctccaaacttggaaagacacggatcatcacagatgccagcagcggcatggttagaaataccggattttgcggtcagatttgccgccgcatggttatctggaacttttaagtatctgtttcttataatattacttatcgccccaaagaggtctatgcttattgcggcaattccttattacgccaatattatgccgcctgaccggcactgctctttccaaacagcttctttaagcagctgaaggcaaccagaacgccgagcaccattaaaagtacggcaacgatgaactgcagtccgtcgacgaggaatgtcgcctgaccgcccgcgatgtttttcaccagagcgatcgtcttctggatgagtgcggtgaacgtcacggcgagcatggcaaacatcggtatgtagagcgtccagccggtgcgtccggttgtctttaagaagactgccagtgcgatcaggacgagtgcggcgagaagctggttcgcggaaccgaacagcggccatacattgttatatccgccgagtgtcagcagatagccgaagaacagggtgatgaccgtggcaaaatatttgtttgtcagcacgcgctgcagcggagacatttttgctggatcggtcgtgtcgccgtagaacagttcctggaaggacatacgcccgatacgtgcgacggaatccagagatgtcagcgcaagcgcggagacgcacatggtcatgaagaccgtggcaacctgtaccggaagaccaaacttctcaaggaaaccggcaacgccggaggagaagatggcgaacggagttccgtccggtttggttccgtttacggcgacagcgccgacaacgacaagggagacaatgccgagcagagattctacgaccatggcgccgtagccgaccatcggcatatctttttcgttgctgatcgtcttggaggacgttcccgaggagaccaggctgtggaaaccggagacggcaccgcaggcgatcgtgacgaacagcgtcgggaaaaggctgctgccgtttacggtaaagccgttaaaagcgtttaactgcatggcaggatgagcgacgagaacgccgaccaccgcgccgatgatcatgccgagcagcatgaacgttgtcatataatcacgcggctgcatgagaagccacatcggcatgacggatgccagaaacagatacgccatgacaatgtagatccaggcggatttggtggtgcagatcggaagtgccatacccactgcaaacatggcaacgagcagcgcgattgcaacaaccgcttttaccacttcattcatcttgccgacatgcttctggatcagaccgaagacaacggcgacgacgataaagagcatggagatggaagcagcggcggagtttgcgtaggaggtctcggcagtcatgccgtccacgccttttccgacgaacgtaccggcaaccatgtccgtgaacgctgcaatgacaagcagggtaaacagccagcagaacagcatgaagagcttccgtccggtcttgccgatatatttttcaataatcatacccatcgacttgccctcatttttgaccgaggcatacagcgcaccgaaatcctgtaccgcgccgaaaaacagaccaccgatgatcagccacaagagtaccggcacccagccgaatacggaggctaagatcggaccggtgacaggccccgctcctgcgatggaagaaaactgatgagaaaacacagtaaatctggaagacggtacgtaatcctccccgtcctcatgggtgtaagcaggagtcttggcgtttggatcaatgccccatttctttgccagccagcgcccgtaaaagaggtagccggcacccagtgctacgattccgattaagataatcactaaaccattcattttttttcccgcccgaaggcggctcctttctgatagatcaacattgggcaaagagaaggatggcattttctgtaaaacaaaaacgcccccgtcccgctgcacgaatgtgcagccaaagacgaaggcgtaagcttccgcgttaccactttgcttgtcgtaaaaaacgacctctcaatctcatctttgcgggcgtaagcctgcagcaataagcttccctgtaacgggggaatcccggtgacacctacttggttcagtgcactgctcgcagaggatagttcctgaaaccgcataccgtctcgcaccgaccgacggctctctgtgatgcggggaatcagtaaaccgtgttctgttccttgcatttgctctttgtttgattatgaagatagcactgtgatgtgtaaaagtcaagtacaaatttttaatgtaagaatctggtaaagacggttgacaaataaaaaaacataatatatagtattcctatcagaacagtatgagaaaggagcgcggcttctatgaaacagatattatgctttggagattcaaatacatacggattgataccgggaacgaaggatcgctatgactgggacacccgctggagcggacggatcgggcagcggctgtgggaggatggctgccgcattgtcgaggaaggactgtgcggacggacgacggtttttgatgatccgttgcgggatggcagacggggaacggagcttttatctgtgatcttagagacgcataagccggttgatgtggttgtgctgatgctcgggacgaacgactgcaagacgatgtacgatacatcggcggaggtaatcgggagaggcgtggagcggctgctcgaccagatcagaagcagcatcccggacagtaagattcttttgatgtcgccgatcgcactcggcgagggcgttggcgaggcagggtacgatcccgaatttgatgagagctccgttgcggtgtcaaagcggctgccggaggtttaccggcggatcgcgcatgagcggggcatttcgtttctggcggcatccgcatatgcaaagccaagtgaggaagacagagagcacatgaatgaggaagggcatgccgcgctggcggaggcagtgtatgcaaagttaaaggaaatgctcgccggagagaaagagaacgcacagatcccggcctaggtggatcctgcgggacgatgatggctgctgaaccgcccgggagcagacggcataagataacagcagaagacgctgctgcgcggaggaagagacatggcagagaaaaatctggattttgacacggtcattgaccggacacataccaattcactcaaatatgattttgcggtacagcggggaaagccgaaggacgtgctgccgctttgggttgccgacatggatttccaggtttcttcctatatacaggaggcgctctctggcaacgtggcgcacggcatcttcggctacagcgaggtggaaggcagctactttgaggcggttgcgggctggatgagtcggcattacggatggaacgtggaggaaacctggctggtcaagacgccggggattgtttttgcgctggcacaggcggtgcgggcgttcaccgagccgggtgacgcggtgctgctgcagcagccggtctactatccgttttcgcaggtaatccgcgataacggcaggaagattgtggataacacgctcgtgcagggagaggacggaagataccggatcgattttacggattttgaagaaaaaatacgcagctgtaaggtgaagctctttttcctctgcaacccgcacaacccggtcggccgggtgtggacaaaggaggagcttctgcggctgggtgacatctgcgagcggtacggagtgattgtggtcagcgatgaaatccacgcggatttcgtctttgagggatcgcatcaggtgctggcgggactcgaggaaagctaccggaaatttgtggtgacctgcacggcgccgagcaagacctttaaccttgcgggacttcaggtctccaatatttttatcccggatgatgcgctgcggcggaagttcgagcaggcggtcggggcgtccggctacagccagcttaacaccatggggcttgtggcatgtgaggcggcgtaccggcacggcgaagagtggtatgaagcggtgaaagcatatatccgtgagaatcttgcctatgcgcagcattttctggaagaacagattccgcaggtaaaggcggtggagccggagggaacgtatctgctgtgggtggatttccggagtctgggactctcaaggagggaactggaggatctgattgtaaaaaaggctggactgtggctggattccggtgacatcttcggcgcggcgggaagaggcttcgagcggatcaatgtggcatgcccgcgcagcgtgctttcggaggcgttagagcggctcgcgcgtgcagtgcgggaatgtgtcaaatgaccgatcgtgtgtaaataggaaccacttatgaaaaatggggtgcaaaggcacctcatttttgttatgttaaatacagttcttgaggacacgaaaacatgccggcagaggaagaaatttcggagaggaggagcatgtgaaaatcaatattgaactggacaaagcactggaggagactgaggtactgatccgggcagcgaaaatgacagaggaagtcaacggaatcctaaaaaaactggaggagccgtcggtacagatgatctccggttttgcgggagacacactggagatactggagcaggcggacattatccgtgtgtatgcggcaaaaggaaaagtctacgcggtgacggcaaagggcgaatatctgcttcggatgcggctttacgaggcggaggaacggctggatcagacgcgtttcgtacggatctcaaattcggagatcatcaatctgaaaatggcaaaacggtttgacctgagtttttcgggtacgatctgcgtgaacctcgcgggagggcagacggcttacgtctcgcgcagatatgtggcaaagatcaagcggctgctgggaatatgagaaagggaatggtgagagatatgaaaaagaaagtgttactgagaggactgttcggaattccaaccgggattgcgatcggctatgtgatcacggtcatgatgtcggcattctggggcgacggcagctactatccgtgtgtgcccgcgtttgtggacgcgatggggagtgagatacgggcagttgtggtgcagacggtgctgtgtggtctggttggcatggtgtatgcggcgggatcggtcgtgtgggaagtggatcgctggagtcttgccggtcagacggcggcgtattttctgattacactcggctcggtgcttccggtggcgtatgcggcatactggatggagcgcagcgtcgcgggcgtgcttagctacgtcgcaatcttttgtgcgatcttcgccggaatctggattttccagtatcttggatggtgcgccaaaataaatcgtataaataagaaaatagcgcttgacaaataagaaatagcgtcctataatcaattcatacaaaacatagtagttttataggaaaataaaaaaacaccatagaaacggaaatgaattgagaacaggaggattttattatgagtaaaattgctgagagcgcactggacctgattggaaacacacctttattaaagctgaaccgctactctgcggaagcaggcgtaaaggacgcaacgatcctgggaaagctggagtatttaaacccggcaggatcggtaaaggatcgtatcgcactggcgatgatcgaggatgcggagaagaagggcatcttaaaaccgggcgcaaccattattgagccgacctccggcaacacaggtatcggacttgcagcagttgctgcggcaaagggctaccatgccatcctgacattgccggatacgatgagcgtagagcgcagaaaccttctggcggcatacggcgcagaactggtactgacagagggcgcgaagggcatgaagggcgccattgccaaggcagaggaattaaaggagtccacaccgggcgctgtgatcttaggacagttcgtgaacccggcaaacccggcggcgcacaaggcaaccacaggaccggagatctgggagcagacagacggtaaggttgatatctttgtagcaggcgtaggtaccggtggaacggtaaccggtgtcggcgagtacttaaaggagaagaacccgaacgtgaagatcgttgcggtagagccggcgaccagcccggtattatccaagggcacaccgggtgcacataagattcagggtatcggcgcaggatttgttccggatgtactcaacaccaaggtgtacgatgaagtcatcacgatcgagaacgacgacgcatttacagagggaagagcgtttgcacgtagcgaaggtatcctcgtaggtatctcttccggcgcagcattaaaggcggcagccattctggctgcaagaccggagaacaagggcaagacgatcgtggctctgcttccggattccggagacagatatctgtccacctccctgtttgcaaagaactaggagaccgctcgaagagcaaatgccggatcctttggcagcacgggttttgcctgtgccgccggagggtctttttttgaccgtgaaatgtgtggaaggtctgtttttgaccgtgaaatgtgtggaaggtctgtttttgaccgtggaaagtgcggaaggtctgttagtgcatgggaaaagtgcggggcatcccggaaaaacaggcgcagagacaggaaaactctggacatttgctgaaaacatgatatgatatcaaagtatcacaatgacaatctatcgtgacaggtgtcttgtcacctgaaaagcggatgtatagagaacggagataaaaatggaagcagagagagcgaagcggatcaaggaattgcagaaagagaaggatgttgtcattcttgcgcattattatgtggacggcgccgtgcaggagattgccgattatgtgggtgattccttttatctgagcaaggttgcgacgaaggtgccgcagaagacgattctgtttgccggagtgacgtttatgggtgagagcgcgaagatcttaaacccggataagacggttgtgatggcggacgagtgtgcggactgcccgatggcacatatgattacggcagaccggatcgcggaagtgagagaggaatacgaagatctggcagtggtctgctatgtgaactccacggcggagattaaggcggtatcggatgtgtgcgtgacttcctccaacgcggtaaaagtcgtgtccaacattccgcagaagaatattttcttcgtgccggacaacaacctcggcagatatgtggcggaaaagctgccggagaagcatttcattttccacgacggcttctgccatgtgcataagagcattcacgcggcagagctgcaggcggcaaaggatgcctgtccggacgcactggtgctgacgcacccggagtgtaccgaggacgtggttgcgatgtccgatttcgtgggaagcacgtctgagattattgattttgcgacgcagagcgactgcaaaaagttcatcatctgcacggagatgggcgtattctttgaactgcagcagaagaatccggataagaagttctattcggtgggacacagacagttctgcccgaacatgaagaaagtgacgatcgataaagtcgagcaggtgcttgagaagctcggcagcggagaacttgaggagatcacgctctccgacgagatcctgacccgtgccgcaaagccgctgcagcgcatgttggaacttgcaaaataacggcggacgctatatgatagaagcggacaggcgtaaacgttacaatatacaggagtatctatgttaaatcaattttccagaacagaattattattaggaaaagaggctatggagcggctctcgcgtgcgagggtcgctgtttttggcattggcggtgtgggaggctacaccgtagaggcgctggtgcgcagcggtgtgggagctatcgatctgatcgacgatgataaggtctgcctcaccaatctgaaccgtcagatcattgcaacgcgcagcaccgtagggaaatataaggtggaggtcatgcgggaccgcatcctcgacattaacccggactgtaaggtggaggtgcacaagtgcttctatctgccggagacgagagacgagttcgatttttcgagctattcgtacgtcgtggacgcagtcgataccgtgacggcaaagattgcgctggtcatgcaggcgcaggagacaggaacgccgatcatcagcagcatgggcgccggcaataagctgaatccggcaatgtttgaggtggcggacatctataagacgtcggtctgcccgctggcgaaggttatgcgccgcgagctcaaaaagcgcggggtgaagaaactgaaggtggtatattccagggagcagccggtcacgccgatcgaggatatgtcgatcagctgccgtgcacactgcatctgcccgccgggagcaaagcataaatgtacggagcgccgtgcgattccgggttccaacgcatttgtgccatcggtggcaggattgatcattgcatcggaggtcatcaaggaccttgcggcagaatagagaatgagggacaggcatgtatcagagaaccatagaagaactgcagaaggacgagcgggaaaaagtaatcatagacatccgcagagaagctgattttttgagagagacatatccgggagcaaagcatatctactgggaggagtttgaggcgcataaggacgaggtgcccaaggactgcccggtctacctgatctgctatacgggagagcgcagcgacgagctggcgcgcgagcttttagaggagggttatgaggtatacagtgtgcagggcggataccgtgcgtacctgcgcatgaagctgttagaatccatggaacagacaaaagcgccggatgccgaagagaagaacctggaccgctgcagcgagatcgagcgcagcattgtcaaaaagttccgcaaagagatctggcggaagttcacaaaggcgatcaacgaatacgagctgatccaggacggtgacaagatcgccgtctgtatttccggaggaaaagattccatgttgatggcgaagctgtttcaggagctggagcgccacggcaagaagaatttcgaggtggtattcctcgtcatgaatccggggtacaatgagatcaactacgagacgatcgtaaacaacgccagaatcttaaacgtcccgatcacggtatttacttccgagatctttgacattgtggcgggtgaggaggaatctccgtgctacctgtgcgcgcgcatgcgcagagggcatctctacagcaaggcaaaggagctcggctgcaacaagattgcgctggggcatcattttgatgatgtgatcgagaccatccttatgggaatgctttacggggcgcaggtacagacgatgatgccgaagctgcacagtacgaacttcccggggatggagctgatccgtccgctgtatctggtgcgcgaggaggacatcatccactggatgaattacaatgacctgcactttattcagtgtgcctgccgtttcacggaaagctgtgcttcctgcggcggtacggagaagggttccaagcgcgcggagatcaaggatctgatccgggagcttcgcaagaagaatccttacattgagaagaatatcttccgcagtgtggagaacgtcaacctgaacactgtgatcggttataaaaaagatggtgtccgccatcattttctggatgaatatgacaaagcataatctttgattttgtgtcatttttatccccccgaggggcttgtgcggcccctctttttcatgctatcctttgtgcactgggcagaaatgccggcaattttaacaagggagaataaataatgaaaaagaggtggatggcgctgcttggggcagcggtagtgacgatgaatctgtttgccggatgcggcagcacaggtgcggagcagacaggcaataacgcagatggtacggcgacagaggcagtacagggaaaagacagcgccggagacgggaatgcggcgcagagcgtggcaggaaccgcggatacggtcatcgtggcgatgagtccttcgtcggagccggcggcgggatttaacccgtgcatcaactggggctgcggggaacactgccatgagccgctgatccagtcgacgctgatccggacgaacgtggatatggagttcgagaacgatctggcgacggattacagtgtgagtgaggacggactgacctggacgtttcacatccgggacgatgtgaagttcacggacggggaaccgctgacggcgtctgatgcggcatttacgtttaacacggcgcttgccacgccgaattcggaggcggacttaagtatgctcgattctgtggaggcaccggatgataccacggtgattttccacatgagcaagccgtacaatgcgtttttgtatacactggcggtgttcggtatcgtgccggagcactgctacgatgaagcagcctacggggagaacccggtcggttccggcagatatatcctgacacagtgggacaaagggcagcaggtcgttttggaggcgaatccggactactacggggatgaagtgcagatgaaaaaagtcattgtcctgttcatggaggaagacgcggcgcttgcggcggtaaaagcgggacaggtggatatcgcctacacgtctgcggtgtacagcgacgagcaggtggacggctatcagcttctggtctgtaagtcggtggattccaggggaatctcgcttccgtcgattccggcgggcagcgaggttgtcgacggggataccgtgtatgcggcgggaaacgatgtgacatgcgatgtggcactccgccgggcgatgaactacgcgcttgaccgtcagaccatgatcgatcatgtgttaaacggctacggcgaggtcgcttacagcgtatcggataacatgccgtggtcgagcgagtccatgattatcccgtatgatgtggaaaaggcagagcagattcttgcggacggtggatggagtgatacggacggcgacggcattgtggaaaaagacggacagaaagcggaatttaccgtgtattattccgcgtccgattccgtgcggcaggcgctcacggcagagctctccaaccagatgaaagcggtaggaataaacgtattatacgaaggtctgggaagctgggacgagttgtatacaaagatgtactccgacccaattacctggggctggggttccaactcgccggtggaggattatcagctgtattataccggcggttcctgcaattttacgggatattccaatgagaagacggacgaacttctggatgcggcacttgctgcgacagatatgaatgagtcctacagtctctggcagcaggcacaggaagatgtcggaccggatgccgaggcactctgggtatggtttgccaacgtggatcatctctactttgcgcgggatggcctggcagtggcggagcagaagctgcatccgcacggtcacggctggtcgttagtcaacaatgtcgaccagtggacctgggaatagatgagggaagaatgaatatcaggcattacataagctttttcataaaaaatgtaataaaaatgctgacactgctgatcggtgtcagcattgccgcgtttatgctggtgtcgctgtctccgattgatccggtacaggcgaacgtcggagcgacggcttacatgcgcatgacgccggagaaacgggcgcagatggagtcctactggggaaaggatgtgccgccggcggagcgctatctgaactgggcgaaggattttgtgcggggggatatgggcacttcgctgaaatataaccgcccggtcgcggaggtcgttgcggagaagttcggcaactcgtttgcgctgatgtgcgtggcgtgggtactgtccggaattctggggcttgtgctcggcattgtggcggggtattttaaagaccgtctgccggaccatctgatccgcgggtatgcgctgcttctggctagcacgccggcattctggatcggtctgctgctcttgatgatctttgccgtgtggctcggctggctgccgttcggcatgaatctgccggcaggcatgacggcggcggaggcgggcatcggcgtgcgcatccggcatctgattctcccggcgctgacgctcgggctgacgggcgtggcaaacatcacgctgcacacccgggaaaaaatgattgcgatcatggagagcgactatgtgctgtttgcgcgcgcgcgcggggagagcagcggctatatcgtaaaaagacatgccctgcgcaatctggtgctgcctgccatcaccctgcagtttggttccatcagtgagatctttggcggctcggtgctcgtggagcaggtattttcttatccgggactcggacaggcagcgattgatgccgggctggggagcgatgtgtcgctgcttttggcgatcacggtcatcagcacactgttcgtattcctcggaaatcttgcggcaaatgtactttacggtgtgattgatccgcagataaggaggggcagaagtcatggataaaaccggtcatatgacgattgctgcccacacggcgggcagacgcaacgggcgccagtggatgcggcgctttcttctggcggcagtgctgcttttagcagccgttgcagtggctggaatctgtctggaggagcgggcggtggtcacggatttttcgcgcaaaaatctgccgccgtgccttaagtatctgtttgggacggactggatggggcgtgatatgctgtcgcgcacgctggcggggctctccacgagcatccgcatcggtgtgctggcgtcggcggtcagcgcagtgcttgcgcttttccttggaactgccgcggcggtcggcggaaaatgggcggacggcatcatcagctggtgcattgatctgatgatgggagttccgcatattgtgctgttgctattgatttcctacgcgcttggaaagggtgaaaagggtgtggttgtcggtgtggcgctgacacactggccgaacctcgcgcgcgtgatccgcggggagatcctgcaggtgcgggaggcggcgtacgttggcattgcaaaacagctcgggaaaagtccgtggtacattgccagatggcacatttttccgcagattcttccgcagttccttgtgggactggtgttattgttcccgcacgcgatcctgcatgaggcgagcatcacgtttctgggctttggactgccgccggagaagccggcgattggcgtgatcctctcggagagcatgtcgtatctgagcaccggaaaatggtggttggcgctcttcccgggactggcgctggtcggcgtggtggttcttttcgaccggatcgggagcggcttaaaggcgctgcttgacccgtcgagcgcgcagctgtagaagattttgagtggagaaaaacgatggaagagaaaaaagaattactgcgcatcgagcatctgacggtatctttcgcgcagtatgagaagcgcagcgcaaagcaaggggaacttccggtgatccgtgatctgaatgtgacggtgcgtgagggtgagatcgtcgcggtcgtcgggagcagcggatcgggaaaaagccttctggcgcatgccataatgggaattctccccgccaatgcggctgcaagcggcagtattttttaccggggaagcgcctgcggcgaggcggaattaaaggcgctgcgcggcagggagatcgcgctggtgccgcagagtgtcaattatcttgatcctctgatgaaggtcggcagacagatcattggggaaacgaagaagcggcagaagcttttttgcggagcagaccagggaaagcggcagaagcttttttgcggagcagaccgggaaaagcggcaggaggaagcgcggatgcgggaactccttgcaaggtatgggcttgcggacgaagttgcggatctctatccgtttgaactatccggcggcatggcgcgccgtgtgcttttactgacggcactgatgtggcagccgcgcctgatcattgcggacgagccgacgccgggcatggatcttgcgctggcaaaacaggcgatgcaggatttccggacatttgcggacgatggaaacggtgtgcttctgattacacatgatctggaactggcgcttgaagtggcggaccggatcgttgtgttttatgccgggacgaccgtggaggaagcgaaggtgacagattttgcggacgagacgctgttgcggcacccatatacgagagcgctgtatgaggcgctgccggggcgcgggtttgcggcactgcccggaacacagccttacgtcaaagatctgccggcaggatgtccgtttgcaccgcgctgcgccgaccgtcgggaggcgtgtgacggggagattccggtcgcttgtgtacgcggcggcagggtacgctgcatattgtatacagagaattcataaagaactatcagagggagaggaggaaacgtccggtgagactgaaagcggaacatatcagctataaatatccggggggcagcagagaggtgctgtcggatgtgagtctggaactggggagtaccgaccggctggggatcgccgcgccgagcggctttggtaagacgacgctctgtcagattctggcgggctgccgcacgccggtgactggacgtgtctgtgtggatgatatgccgcttccggggagcggttactgcccggtgcagatgatctggcagcatccggagcaggcggtcaatccgcgcgtgcggatgcaggcggttctgcaggagggagattcgatcagcgaacgtgtgatagaggggctcgggattgagcgggattggtgtaaccggtatccgggcgaactatccggaggagaactgcagcgattctgcatagcgagggctctgggggagagaacacggttcctgattgcagacgagatcagcaccatgctggatcccatcacccagagccagatctggaacttcctgctggcggaagtgaaagaacgaaaaatagggcttctggtcgtaagccacgacgaaaagctgatggagcaggtctgtgaccgcatcatgcggctgtgatgcctgcaaataaaaagaaaaatcagaatattatcttcgcgcggttcttcaataagcgcgcgccattcacaatgagaagaattccggctgcaatgccgcctgtcagtacgcagatgccgacggcaaggcttgcagcgccagtcgatcccattgtcttgtaaatcttttcttccataaaaacaacctccttaatacaaaacaatccatttatggttagtattttaccatcatttggcggaatatacaagaaaacggtcacggcagccagccgtcgtcccccgccagcacaagctctctggaaaaatgggcagcctgtgcgccgtctaaggtatccacaaagtctgcacgctgtgcaaacgggcggcagctgtctgcacagccacagtcagcgtcctgtggataactgtgatactcggcaaaaagaacggtgccgtgtgcgtgctccttgccccagtcatgaaatccggcaggatgaatgtgggcgcctatcgcgcagtccatgaggacaacccgtgcgtaatcccgccagggacggccgatataggccgcgtgctgaggacaaccctccgcggcaaagcggcagtcgtggaaaacatagccgtattcctgcccttcgggggtggaagcggcggtgacatatccgggtcctaaggatgcgatcgtacagccttcaaagtaagcggtcgcactgccgaaaataaagtcgatatcgccgcagatatagcagttgtgataatattgtctgccgttgatgcgcggtgcggactcggtcggcccgcgaaagccgccgggctcgtattcctccgggggaagcggaccggtaaaaagcgtatcctgatgcccgagaatccggcagtattccgcgacaaaacggtcacattcggcatagagtgcaattgcctgcccgtgcgttttggagtcgccggcagtattctcgatggttaagttgcgcagcgtaacgtctgcggcatgcacgaaaaaggtgtaggagcggaaggttccgcgcttgatgccgtccgacatgatctcgtagccgtaatcgccgaaggagatcacggtgtcggacggggatgctcctgcgccctcgatcgtgacgttcgggcgtgtgagggataatttttcgtggtagattccgggcatgacgcggatggtcacgggaaccgccggatcttccggcatggcggcgaacgccgctttcagtgaataaaagccgccagagacatctgcccctggcgcaacggtcattgtatacataagtggcttcctttttggaaaaatagaattaacgggcgagaatatcgatgatctccgcgacatacatggtgtgcatatcgccgtccttgtaccatttttccttgatctcagggagaagaaaagagtcttccgtgatgcgggtggcagacattttctcgcagagaaggacaaagttgccctcgtccacgtaagggatgttgtggcgcgtggcgaggttaagacctgccgcggcgaatttgtcttcgtctcttccggaatgggaaccgcagtaatttaatgcgtcacggtattgcccggacaggaaggtaatggagaaaaattcgttcgcgtcgatgaattctttggtgtagcgggaatcacgcacaaaaatgaaagcaacatttttgccccagaggacaccgacaccgccccagcttacggtcatcgtgttggctttttccttgttgccggctgtgacgagcgcccactctttgccgattttggtaaatggattaaattctacaagatcaaatggtaacggttggaatgtgtgcataagattacttcctttctgtcggtatcatttctgtagatatgataccattttgacgggaaaatgacaagaaagccggcggcaaaacgggatacttttcacaccggaaggggcgcagatgagcgccagagcagttgaaaaaatagacggagtgcgtataatagtaatatagtacgcaaaaggaagaaggaggagcggcgatggcaggattaggccacagacaggatcggggagtcatgctcccgccattggatgagattgacggttttatggtgcgcccgggattttacaattcagaaggcgcagtgccgacggcgagaggagtgagctttacgattcattcggtcggcgcgacgggatgtacgcttctgctgttccggccgcaggaaaaggagccatacgccagactgaagtatccagaggcataccacattggcaacacgttcgcaatgctggtattcggcttgaagattgatgaatttgaatacgcgtttcagctggacggaccgtatgatgagtccagggggctgttgtttgacaagaacaatgtgctgctggatccgtttgcgaaggcagtgacggggcagcggaactggggcgagcgcccggagagtgacgagggctttgtgtatcacgcccgtgtggtggagaataattttgactggggaaaaatgacgtttccggagattccggcggaggatctgatcatatacgagacacatgtaagaggatttaccagggacgcttcttccggggtgacggcaggcggcacgtttgagggactgcgccagaagattccgtatctgaaggatcttggcgtcaacgcgatcgagcttctcccgatttttgagttcgatgagatggagagcgcccgtgtggtggacggcgtgcagctgtacaattactgggggtacaatacggtaagcttttttgcgccgaacaccagctattcgtccgtggtagagcacaatcacgagggagacgagttaaagctgctgatcagtgaactcaaggcaaacggcatggaagtcattctggatgtcgtgtttaaccatactgccgagggaaatgagaatggaccgtgtttttcatttaagggcattgataataatatttattatatgctgacgccggatggacattactacaatttcagcggatgtggcaatgccatgaactgcaaccacccgatcatgcgcaagtttatcattgactgcctgcgctactgggtgatggagtaccgcgtggacggttttcggttcgatctggcttcgattctgacgcgtgaccagaacggggcgccgatgccggatccgccgatcttacaggggatcgcctgcgacccgatcttaggacatgtgaagctgatcgccgaggcgtgggatgcggcaggactttaccaggtgggaagctttccggcatttcgcagatggtcagagtggaacggcagatacagagatgatatgcgccgctttttaaagggcgacgggagcatggcgggaaccgcgatcaaccgcatcatcggttcgacggatctgtacgatccggtgcacagaggtgagagcgcatcggtgaatttcctgacctgtcatgacggttttacgctctatgatctgtactcgtacaatacgaagcacaatgagaaaaacggctggaacaatacggacggcgacaacaacggaaacagctggaactgcggtgtcgagggagagacggacgatccgcagatcgagggactgcgccggcgcatggtgaaaaatgcgtttgcgacgctgctctgcagccgcggaccggcgatgttctacggcggcgacgagttctgcaacacgcagtttggcaacaacaatgcctactgtcaggacaacatcatatcctggctggactggacgaggctggaaaaataccgggagattcatgattttgtgcggtatatgatcgatttccggaagcgctatgccattctgcgcaagaagacgaagccggtggcatgcaatctgccggagatcagcattcacaacggttatccatggaacggcggtacggattccaacagccggctcatcggcatcatgtatgcgggaagagatgagcacgacacgcgggacgatattgtgttctattgtatgaatgcttactgggagacgttagtgatgcagcttccggaactgccgaacgggctccagtggaaagtgtgtgtcaacacgtccgtggagtacgaggacggcagagatatggagtcctgcacagaattttattataagaagacattgaaggttccgccgcgcacggcgatcgtgctggtggcggagtaagcgggctaagcgggcagaaacccgtggcgaatgcctacagcctgcgttgcggctcctagaggtagccgccgtcgagggtgatgatctgtccggtcaggtagtcgtttccggtggtaatctgcacggcaagcgatgccacttcctccggcgcgccgaagcgcccggcggggatttcctcggcgagctgggcgcgctcttcctcggaaaagcaggaattcatctcggtgtcgatcacgccgcaggcgatcgcgttgacctggatgttgctcggagcgagctccttggcgagggcgcgggtgaaggaattgatgccacctttgcaggcggagtatgcgacctcgcatgaggcgccgacatttccccagatcgaggagatgtttaagattttcccggatttctggtggatcatgtgtggcagggcaagcttgctcgcggaaaagacggaggtcagattgacgccgatgatgcggttccactcatcgatggtcatatcttccagcaggccgatatgcgagatgccggcattgtttacaagaatgtcgatgccgccgaagcgggcttcgctttgggagaaaagctgttccatataggtatagtccgatacgtcgccgatgctggtgagtacgtccacatggcaggtttcccttaattcgtctgccagcgccagcagctccttttcggagtgggaacagttgatgaccagacggcagccctccctggcaaaggcgcaggcgatcgcccgcccgatgccgcgtgaggcgccggtaatgagtacggttttatacatgatgaaagacctttcttctatttatattgtgaatacggtatatcctctttttgcgctgctttctgcgcatccgaagttccgcaggaacttctaatatgaactcgtcagagttcattatatcctcttttttgcgccgacttctgcgcatccgaagttccgcaggaacttctaatatgaactcgtcagagttcattatatcctcttttctgcgccgacttctgcgcatccgaagttccgcaggaacttctaatatgaactcgtcagagttcattatatcatatattttaggcggctttgtttgaaatttcaaaaaaattaaaaaaatacaaaatttttctggacaaacagaaaaacttgtgataatataatgaagcacgatttgagagacaacaaagtgcttcataaatatcgatgcgtggctcagcttggtagagcgctgcgttcgggacgcagaggtcgcaggttcgaatcctgtcgcatcgactgactggtagagaccgtcaaccttagagagatcaagggttggcggttttttgtgtatagaatatcagaagaaaaggatcatgaatgttaagagagaagatagtacactttcttgcctgataataggttcactgcttgtcagataggatggattttgttaaaataattacaaaagcaatacaaacaatgacgagaggaggaacctgaatgaactctccgcagacaatcaatgggttaatgcggcatttgagaaatgattgcaaaatacaaattagcggaagttatcaaaaacagcaattaacaagctatggctattatcatgggtataagggataccgttttgccggaaatagttacaggcagattccatattctgatttcagcgaggtggtagcggttattgagtatgataataatttgaaggcagcgctgtatccggaacttatgtttattgagacagcacttaaaaatattgtgtgcaatgaatcagtgaaaggtcttaagcttggcacttttgagcatctttataaagaacgtatgagtgataatacgacaaatacgaaattgcagtcaaaacgccttaaattgcgtaattcggtgtacgccaaattagctgcgcgctatcatgatgaagaagaaaaagaaaatcaaatggtgcggcacttttataatagaggagaagatgcacctatctgggtcgtttttgaaatactatatcttagtgatctggcaggtttttttgagtgcctaaatgaggcggtacgtgagaatatcttaaagcagatgaatatgtttgatatttcgatagatgctaataaaaatttactttctatcatgatttacactttgaaagcactgcggaattctgttgcacataataatattattttcgatactagatttaaagatcggaaaatcagccccgtgcttaaaaaatgggtagaaaaagaaacgggtattcagaatattacgttgtattctctgattgattatattataattgtgtgctgtcttcttaaacgagtggattttagtggtacgagagcattgactttgctaaataagtacaaggaagagaatcagcgactgcagaatagtgttgcttcggagatttacgatcatattatacagaataatgttccggcaaaggttgtggggttagaggcgtatttgaatgtttgaaaaaataataaaaacttgcatttttcaaggatataagatatattatatgtaatgaaagaggtgtatgttttcggactgcactggaggagtcactctgtggctcctttttatgtatgggctttagtctgtatgggcatttaatgccgggtgatatccataggaaggaactcaaaaaggaactcaaattatttgagttcctttttgagttcgtgaaataaaatttgagtttcttacacaaaaaatagtgatacgatataaaaatatggggagaactaaaatgacaacgaaagaattacttgaaaaattagagttaattcagaaacttaaatgtgaaactccaacagataaagagtgcaaaccagggatgtcccagacatttatatgattcgctgtccagtttttccaatcaggacgatggggaatcccgacaatacgcagaacgatgcaggaatatcacttgccacaaccggaatttttggatgaaagaaggagttttattgcgattaaaggaaaaaggatcaaggataaagattctgtcaacagaacgcgaattgccttgtcaaagcccctggtgcagtgtataattgcactgatgatttgcgagtgaagaacacgggaggaagacatgggaaaagacgttattattgcatgtgattttaacagtaaggcagaagtcattgcgtttcttgagaagttcaaggacgagaagccgttcgtcaagattggaatggagcttttttatgcggaaggaccggacatcgtgcgtaccatcaaggggatgggacacaagatcttccttgatctgaagcttcatgacattccgaacacggtgaaaaaggcgatggcggttctctcgggactggatgtcgatatgtgcaatgtacatgcagcgggaacaaagggcatgatgcaggcggcactggagggactgacgagagcggacggcagcagaccgctgctgatcgcggtgacgcagcttacctccacgagcgaggaagtgatgcagcaggagctgtggattgacaagccgatcgatgagacggtcatgcactatgcgaaaaataccatggaagcaggactggacggagtcgtatgctcgccgcttgaggcgggtaaggtacatgcagtctgcggagaaaagtttttgacgatcacaccgggcgtgcgttttgcggacggcgatgtgggagatcagaagcgtgtgacgacacctgcaaaggcaaaggaactcggatcggattacatcgtagtcggaagaccgatcacacaggcggcggatccggtagcggcataccgcagatgtgtggaagaatttgtaggttaggacggcatacacgaagaggagatggacgaaacagcctggtctcctctttttttcataggaagaaaaggacggtggggaagatgcctcaaaaaggattgagcggaagcacattgaagttgatcgcgatcatcacgatgctgatcgaccatatcggagcggcggtcattgccagactgctgattgccggacaggggagtgagatgctctataagatctattatgcgatgcgcgccgtcggcagagtggcattccctattttctgttttctgcttgtggagggatttttttacacgggcagccggaaaaaatatgcacttcggttgtttggatttgccctgctgtcggagataccgttcgatctggcattttccgggaaaatactggaattcggctatcagaatgtatttttcacgctgctgatcgggcttcttacgatcatgctgtttgatgcggtggtgaaaaagcaggagtggcatccggttttgcgcagtgcgctgcttgtcatcatcacattcgggggaatgggtgcggcctatctgctgcacacagattatgatgcaaaaggcgtgctcgcaattctggtgttttatatgacgagacagatgcggggattacagatcgtggcaggctgcctggcgttctgctgggaacttccggcgatcgtggcgtttatcccgattgcgttctataatggaaagcgcggatggaacataaagtacctgttctatgcgttctacccggtgcatctattggttctttatctgatctgtgtagggatgggaaccgcgcagattgcggtggtgtaggagagaaagagaggaagagagtaagtatggagatatcaaaggagacgcggaaacggatgatgcagatcattgcatttgggattctgctctattgcgggatggagcattttgacgtggtgatcggagcggtggattttgtgctggggattgtgatgccgtttctggttggaggcgcgatcgcattcgtgatcaatgttccgatgaagagtatcgagcggcatctgtttgcgaagaacgggaagcttgcaaaatggagaagacccgttgcctatctgctgacgcttgcgcttgtgatcggtattatcacgctggcacttgtggtcgtgataccggagcttggaaatacgatttccatgattgtacagcaggttccggttgcggtaaaagccgtacagaagtggctgacagatcttccggacagctatccggcacttgcccctgcggtggcggagcttaatattgactggtcatcgcttgccgactcgattgtgacgtttgtgcagaattttgcggcgggggttgtgagctccggcgttggtattttttccgggatcgtgagcggtgtggtgacgtttgtgattgcgtttacgttttccatctatgtgctgttccagaaggagcgtctggcgagacaggcaaaacagattctgtacgcagtctttccggagaaggccacggagaagattctctcggtggcagctctgtccaatcaggtgttttccagtttcctgtccgggcagtgcgtggaggcggtgattctcggcaccttgtttgtcattaccatgtcgattctggggatgccgtatgcgatgctgaccggaatcgtgattgcgataacggcgctgattccgattttcggcgcatttatcggctgtgtcatcggaatgcttctgatcgtgatggtagatccggtgcaggcggtgtggtttctggtgctgtttctggtgctgcagcagatagagggaaatctgatctacccgcacgtggtgggaagttccgtcggactgccctccatctgggtgctggtggcagtgaccgtcggcggcaacatgttcggcatcctgggtattctggtgttcattccgctttgctccgtgctgtacgcactgtttgccatgtttgtgaaaaaaagactgcgggagcgggagattcccgagagccgctggaacgcgccgtcaggcggcgctgcggcggccgggccagaggttagtgacaagaccggcggcagcgggaataccgccgggtaatttggggagagaagagggttcttccgcgataagatcaggcagcttttttatccgcagaagagcagtcttgtggataaatgaaaaaaagcctttcggaagtgtaggagggacttccgaaaggctttttgaaatagtgtaatatagtatatggaatatatataaaacccgccggcagtgccggtgagagagtttttaggcggaactgacagaaccccaacccccgcgtcgaaactcaacagctccttttgatgattctatcttatcgggaaaatgtgtcggaagcttgacggcaaaatgaagaatgtcttaatatagtgtaagaaatttctaaaaagtggaaaatatttataaaatggcgttggaaaaaggggaagcattacttggaagcatacgaatatctggaaaaaataagagcggcggcgccgcgggtacactgtatcacgaattatgtgacggcgcatgacgtggcaaacatgatcctggcgtgtggagcgaacccggtcatggcggacgagccgcaggagatgggagagatcacggcgcatgcgggggcgctcgcccttaatatgggaactcctggcgagcgcagagagcaggcaatgcttgcggcgggaaaggcggcaaacgggaacgggattccggtagtgcttgacccggtcggcgtcggtgcgagcgcatttcgccggaagatggcagaagagctgttgggggcggtgacgtttaccgccatacgcggcaacatgtcggagatccggacgctttctgaactggcagaaaagaaggcggccggcgccgcgggcggtgtggatgtgcgtccggtggatgtggtcacggaggagacgctcgcggaggcggtcacattcgtaaaggcggtctctaagcgccttggcgcggtggtggcggtgaccggtgcgatcgatcttgtctcggacggacagcagtgtgtggtgatccgcggagggagagaggaaatgagccgggtgaccggaaccgggtgccagctctccggacttgcggcggcgttcctcgcggtggcgcggaatatggaagcgccggctggaagcaccggcgggaatactgcgggaggagcagcatgcgcggcgcgcggcatggaggcggtcgcggcggcagtctgcgtgatgaatgcagcaggagagattgcatgggagcagcgcggtttatgcggcggaaatgcctcctacgggaccggtatcattgatgctgtgtaccggatggaccagaaaatgctggagggaaggattcgttatgaagtgcgataaaagagatctgctgctttatgcagtgactgatcgaagctggagcgagggaacaacgctgggggcgcaggtggaagaagcgctccggggaggcgcgacatttgtccagctacgggaaaaaaagctgaccggggaagcactccgtgcggaggcgttggagatccaggcagtgtgccggcggtacggcgtgccgtttgtgatcaacgacgacgtggcgcttgcgaaagagattgacgcggacggggtgcatgtcgggcaggatgatatggaagccggcgatgtgcgtgccattctgggcgctgacaaaatcatcggcgtatctgcgcataatgtggaagaagcgctccgcgcagaacgccatggcgcggattatctgggcgttggcgctgcgtttacgaccagttccaaaccggaggcgggacacattgatgcggcgacgatacgtgccatctgcgagacggtaaagattccggtcattgcgatcggcggcatcaaggaggagaatcttctgcagctgcgcggaaacggtctgtgcggcgttgccgtgatcagtgccatttttgcacagaaggatatcgaggcggcgacgagacgtctgcgcgctctggtagaggaaatggcgggggatcaggaatgaagggggcaatttttgatatggacggcacgctgctagactccatgcaggtgtgggttcacgtcggcgagcagtatttgcggaaccggggaatcgaaccggaagaagggctcggagatgtgctttttcccatgagcatgcgggacggagctgtgtatgtgaaggaaaggtacggtttgccggattcccccgatacgattgtgacggacatggacgcgattgtgtttgcggcataccgggatgaggttctgccgaagccgggcgttgcggtatatctggaatcgctcaaaaagcggggaataccgatggcggtcgccaccgcgacgaaccggccgatggtggaggcggcgctcgcgcggacaggacttgccggctattttaaacagatttttacctgcacggagatcggcgcgggaaaagaaaggccggacatctatctggcagcggcaaaggcacttggtacgcacccggcggacacctgggtgttcgaggatgcgctctatgcgattaagacggcaaaggcagccgggttttatacggtggggctttacgatgagacgagcagaaatgatcaggaggcgattgccggcctggcggactgctatgtgcgggagattcaatctgttcccacacaagactgtacttgagaatgtaatgctggcgcctgttcatgtaaaaaagatggagaaaggaaggacagaagctcttgcaaaagaacggatcggaaaagtcggacttgcggacaaggttgtctttatggcggatggaagaattcttgaggaaggaaagccggaggagattttttccaatccgaagacgccagaggcaagacagttcctgcggagcgttctgtagtagggtgatgaataaatttgtgatgagacaatctttgctgctgcttttgacggcaacgatctggggcgttgcgtttgtggcgcagagtgttggaatggattatatcggaccgtttacctttaacgtagtgcggaatgtgattggcgggctagtgctgatcccatgtattgcagtgtttcatagaacaggtgcaaaggaagaggatgccggaaagacaccgggaagccggaaaaatctgctgcttggcggaatctgctgcggggtcatgctttttgtggcaggcaatctgcaacagatcggaatacagtatacaacagtaggcaaggcgggatttatcacagcgatgtacattgtgctggtgccgatattaagtatttttttaggaaaaaaggcgggaatcaaaatctgggccgctgtggcgctggctgtcgcggggttatacattttatgtatgacagatggcagcttttccctgcagaagggagatctgttcgttctgctgtcggcatttgcattttcggcgcacattcttgttattgattattttgcgccgctggcggacggtgtaaaaatgtcgtgcatccagttttttgtgtgtgcactgctgtcggcggtctgcatgtggctgtttgagaaaccggatatgggagcggttctgcaggcgtgggttcctgtgctgtacgcaggtgttttttcctgtggcgtggcgtacacactccagattgtcggacagcgtggcatgaacccaacggtggcgtccttaatcctcagcctggagtcggtaatttcattgattgcaggctgggtaatattagggcaggcgctctcggtacgtgagctttccggctgtgtgctgatgtttgctgcaatcattctggcgcagcttccggagcggaaacgtggcgcgtgatttcctgtgattttgcaaatttagcgtagaagtgccagaaaaactgtgatatgataaaaaagggaaaacgccttcggattccgaaggcgttttctgttacagagacattttaggacacgaaagctggtaagagaatgatacgcagagcggtactgcaggatatttctgcattgatggatatatataatgaagcgattcttcacacgacggcaacgtttgatacggaagtcaaaaacatggagaaccggaaggcatggtttgcggagcataacgggcgctatgtcatttatgttgatgtggaggacggcaaggtggcgggatatgcgtcgctttcccgttacagggaccgcaaggcatttgaccctgcggtggagatttcaatttatgtacacaaggattatcgagggcgtggcatcggccgcagcctgatggagaaagtgcttgcctatgcagcagagtgtgacgagattgacacggtcatctctttaatcaccagtgagaatgcggcgagcattcatctgcatgaggtgtatggatttgagtattgcggtcagattaaaaatgcagggacaaagtttggaagaaaactcagtctgaatgcatatcagattctatatgacaggtagagaggatatagggcaaaagctatgatgaaatattttatgaccgataatcaggtgatacatgaggaggagaagctgcaggacggcgtgtgggtgcggatgatcagtcccacgcaggaggaatgtgaggagattgccgatgtgctgaatgtggatatcgacgatatcaaggcagcactcgatgaggaggaaagctcccgtatcgagctgcaggacggatatacgctgattctggtggacgttccgacgacagagatccggcacgataagcagtcctacacgacaatccctctcggcattatcttaacgcaggatgtgatcgtgacggtgtgcacggaggatacgccggtgctcaagaattttgtgatcaaccgcgtgaaggagttcagcacgaaaaagcgcctgcgctttgtgtaccagattctgtaccgcaccgcgacgatctaccagaccaatctgcgcatcattgataagcgccgtacggagattgaggagcggatcggacaacacaccgaggacgtggatctgattgatctgcacgaactggagtccacgctggtctattttgccacatccctgcgtgcaaacggcgtggtgttagaccggctgacgcgctataagagactggagcagtacccggaggatacggagcttctgggggatgttatagtcgagaaccagcaggcgatcgagatgacttccatctaccgtgacatcatcaacggtaccagagaactgatgtcctccgtgattgacaaccgcctgaacaacgtcatgaagtatctgacctcaatcacgattgtcatggcgattccgacggtcatttccggtatctatggaatgaacgtggatgagcggtggatgccgtttgctaatacgccgcacggatttttgctgatctgtgtgctgactctgttgatctgcattatcacgatgctgatactgcgtaagaaaaagatgctatagaacaagcggcgggagaatctgccgcacgatcgaatcacgggcggcgcagcagagcagctgcgcggagagaagagtataatgaagacaaaaatttacggaaccatcggaccagcatgctgtgatacagagatgctggttcatttgtttgaaaaaggaatgacaggaattagaatcaatctgtcccatgcggatctggaagaagcggatgcgtggatctccggcatccacagcgcatggagccggctgcatgacggaacgccagagattctgattgacttgcggggaccggagctccgcatcggtacgcttggggcagaacgtcttttaaaagagggagacggtctgagccttgtggcggacggacaaaacaatctgtttgatccgacggagattccggtgccgggaacgctgcttgtggcgcttgcgcccggacaggagattttgctggacgacggcaggattgcattaaaagtagaagaacaattccgctgcggatcgtctgtcgcggtggaatgtaccgttgtgcggggcggcgtcttaaaaagcgggaaaagtatcgcggcgcccggtgtggagatacagacaccgacgctgacggagcgtgattacaggaatcttgccagagtaaagcagtgcaggatcacaggggtcatgcttccattcgtgagaaatcaagaagacttaaagaacttaaaagaagctttaataaatgaggatgccggggacatccgcattttcgcaaagattgagaatctgcagggaatggagcatctgggggagctgttgccacactgcgatgagatcgtgatcgccagaggagatctggggaatgcgatgcccctggcaaagcttccgtgcgcgcaggaggagattgcggctcagtgcagaaagcacgggcgcgcgtttatggttgtcacgcagatgctcgcctccatggagcaccgggcggtgccgacgcgggcggaagtgtccgatatattccgcgcggtgcagcagggcgcggcatctgtgatgctgacgggcgagaccgctgtgggagaatatccgctggaggcgatggaggttctggtggatacggtgcgggaagcggagtggtatctggaagaacgcagataaaggggcataaaatgtcatttatccagcatctttttgtattcgcgaggactctgtcctacatatttccggaagaggcgtgaaaaatagcccatatcggtgtagccgacggcgttggatacttccgcaacgctcatgtccgtggtgttaaagtaacgcagcgaggcgagaatgcggtgcttgttgatataagttgtgagtgtgtcgccgacttcctttttaaattcgctggagaggtaagaagcatttttgccaaattccgaagcaagcgtggcgagcgataattccgaggacaggtgctggttgatataattgaccacgcttcgtatcagataggaataattgtcataggtaaagtttttcacgagcaggcagtatttgcgtaccatttcataaggaagatgctgcagttcctgcgcctgcacggtttcgttaattttaagctgaaaggtatgcatctgcttaaagatataggcgggatgcacctgtgtgtccatcattttggcagacagaaaagtgttgatgtaggagagatattcctttaactgggagagtggtgtctcggaaaaagaaaccgcaaaattcaacagggatttcatgctttcggaggaggctgtctgatcaccggtgatgacagcatcgccacaggattttatgtgttcggcgaggtttgccatataatcggaagtaaatttgtgaatccgttcctcgttaaagtcaacttcgtgctgttcggaggtataattgatatactcgacgtgattggctgcaaacccggggataaatgcagtgatcagatgctgcagtgtggtgatcagactctgcatttccacgacgggaagattgtagtagacctgctgcatgctggatgtatactgtggcggaatgccgttctccttcatgatgcggttgatgacagccggagttgcaggttcggtacggaacggcatgaagccaaacatatcgggatgctcctcgtttgtaactgtgataatcagattgtaaaagcccagaacactttttaacacgataatctgccaggcatcctgttcgggagacagggagaagatggcagaatttgtggaataggttccccagaccattttgcgaagccccatgtccagccgctccagatcggagtagggataatgcatcagaaaagagtcgactttgtaggtgtctaagatggtctggcggatgaccggaaaacagtcctccacggaaatatagggcaatgccataagaatcctccttgcttgatccaggaactgttagctgcaaataacaacgtgaaaaaattttagtacaaaataaatataacacaaaaataatccgtgtcaaacaaaaaaaggcaaagtacagggaaagggaagttgctataataaaaccatcaaagagaccgcatggggcggtctgctacaggaggcgcattatgggaaacacaaacaccaagccgtttggcgtaaaggacaaaatcggttacatgtgcggtgatattgcgaatgattttacattcattttcgccagcagctatgtaatggtattttacacaaaggtcatgggagtctctgccggtatggtaggtaccatgttcctgcttgcaagatgtctggatgcatttaccgacatcggaatgggacgcattgttgataacagcaagccgaccaagaacggacgcatccgtccgtggattctgcgtatgtgcgcatttgttgcactggcatcgttcatgatgtaccagtcatttctggtagatgcaccgtatgcggcaaaagttgcttacatgttcatcacttacattttatggggatccattttctatacatccgtaaatattccatatggatccatggcatctgttatttccagcgagccgaaggaccgaagctccttatctgtgttccgttctctgggcggtacgctggcaggtatcctgatcggtatgcttgcaccgatggtggtatattacaccgatgaggcaggaaacaaggtcgtatccgcgtccaaaatttccatgatcgcaggaatcttttccgtacttgccgttatctgctatctgttatgctatacgctgacaacagaacgtgtcgcgtatgtaccgaagccggatgtccagaagaagacgttcggacagacggtttccgcactgttttccagcagatcgctgatgggcctgattctctcggcagtgctgttgttgttggcatctttaatgtcccagggcatcaaccagtatctgtttgcagattactttaagaacactgcagcattatccgtatattcgctgctgatgcttccgtgcgtgcttgtactttccgcagtgtccacaaagcttgccgtgaagtacggaaagaaagagtgcagtcttatcggaatgtttatctccgcaggattatattttattattggcgtactgcatgtaaagaatgtatggctgttcgtcggactggcattccttgccatgatcggtatgtatttcttccagatgcagtgctgggcactggtaacggacgttatcgatgacatggaagtgaagaatcacaccagagatgatggtaccgtatacggtatgtactctttcgcaagaaagatcggtcaggcaattgcgggcggactttccggatgggcacttggctggatcggttatgatgagctggcaacaagccagacgcaggaagttgcaaatggaatctacaatctgtccaccttcttcccggcaatcatctatgcattatgcggactggcactgttacttatatatccgctttctaaggcgaaggtagaggcaaacgtaaaagaacttgagtccagaagaaaataatataggcttgttaaggggctgcacattaagcgtgcagcccctttttcgtgcagctcatgtgataagcagcattataagaagcacatatgcagatttccgttggaaatgcagatggaatattcgttggagaaaaatgtgagcatttctaccagttggatgtttgcatcagattccgtgtctcttccacgttttgactatccgacgggtgcatgtccggcacaccggagacaatgggcggacctgacccgcggattgttccaaacttggaaagacacggatcatcgaagatgcaaacatctggctggttagaaatgccatattttttgaccgaatttccatctgcatttccaacggaaaccgcaaagtgcgagttccttataatgctacttgtcaaaatccagcttcacgaaaagggacggctgcctctttttgggcgtatttgttaaggaaaggtcaaaataggtaggaagtccgttcaaatagatagaaagttctatctatggaaaccgatattttttacaaacattggaagacatttttgactgaatgtatatttttgcaattttcaatttgtaaaaaggcggaaaatgtgaaaaaaatcacaatctatgcatgcatattgcacaaaaacagaacgcaaaattagaacttttgacgaaattgacatttaatgggaaacttcataaaataggaacacaaaaaaagagaaaggaagtggtaatacggaggagctatcaaagcagctgatggaagagctgaactgtgagactgcgttcacgatccctgtttttggcgggatccctgtggcagagtcggtcgtggtcacatgggtcatcatggcagtgctgctgctcggctcgatcattcttgtgcgcaacctgaaagtagagaatgtcggcaagaaacaggttgtactggaaacggtagtgggaggcttatacaacttcttttatgatctcctgggggaggatggaaaggggtatatcccatatctgatgaccgtagggctgtatatcggcgtggccaatatgatcggtctgttcggtctcaagtctccaaccaaggatgtgggcgtcactggtgctcttgcactgatgagtatcgtcctgattgaattttcgggcgtacataaaaaaggcgtcaaaggctttctaaaaagctttgcggaaccgatcccgcttatgctgccgatgaatattctggaaatatttatccggccgttatcactgtgtatgcgacttttcggtaatatcttaggcgcattcgttatcatggagctgatcaagatcgtggcaccgttacttgtgccggtaccgctcagcctctactttgacctgtttgacggattcattcaggcatatgtatttgtatttttaacatcactttttattaaggaaaccatcgagtaatcaaatcgaaaaagaaaaggagaacattattatgacatctttaatcgcaatcggagcaggaatcgcagcacttacaggtattggagcaggtatcggtatcggacttgcaacttccaaggcaacagacgctatcgcaagacagccggaggctgacggaaagatcacaaaggcactgttacttggctgtgcactggcagagggtactgcaatcttcggtatggttgtagcaatcttaatcatcttattcttaggctaaggaaaggttatggtagagtatgcagttacttagaatcgactggaatgtcatctttaccatcgtcaatctgatcgtattatatctggggctccgcaaatttttaatcggaccggtcacgaaagtgatggatcagcgcaagcagctgatcgaagggcagatggcggacgcacgccatgtaaatgagcaggcaaacgagctgaaagcgcagtatgaggacgccttaaagcaggcgcatgaggaatcggcgcagatcgttgagaaggcgagaaagagcgcacaggcggagtatgagagccgtatggatgcagcggatacagaggcgcagaaaattattgccaacgcgcacaagtcgattgaccttgagcgtgagaaaaccgtgcaggagctgcagtcgcagattgcgggacttgccatggcggcaaccgctaaggtattgggcgacacggatcaggcagcgcagaacaagcttatgtatgaacagtttttggcgaaaacgggtggtttaaatgacacaaacagcaaataattacggaacggttctttttgagctgggcgtggagaaagagactgtggaagagatgaagcggattttctcactgactggcgaattgccgcgcgtgctggactgtccggtggtatccggcagggaaaagcacaggctgatcgagcagctgtttccgaaagaggtctggaatttcttaaaagaaatgtgcgaccacggaaacgtatcggagatggaggatgtctttaaagcgtatacgcgctgctacgatgaggcaaatggaattttaaagaccgttatgtactgcgcgggtacaccggatgaggagcagcttgcacagattaaagcatatctcgccgcaaagcaccacagagagacggtggagcttaccatctgcacacagccggaactgatcggcggatttgtgctggagacgggagatctggtggaagattacagcgtccgggggcggatcaagaatttagaacaaaaattgacatggaggtgatgacgtgggttccataaattcagaggagattatctccatactgaaaacagagatagaaaattatgatatggtgaccggtgagcaggaagtcggctctgtcatctgggtaggagacggaattgcgaccatctatggcattgagcatgccatgtatggtgagatcgtgatcttcgagaatggcgtcagaggtatggtgcaggatatcaagcgcgatcagatcggctgtatcattctcggaaaagacaccggcatcaaagagggcacaaaggtcacacgcacgaagaagaaggcgggtgttccggtcggaaatgcctatcttggaagaattgtaaatgcactgggagcgccgatcgacggcaagggagatattccggcggacgattaccgcccgatcgagcaggaagcgccgggcattgttgaccgtcagtcggtcaagcagccgctcgagaccggtattctggcgattgacgccatgttcccgatcggacgcgggcagcgggagctgattatcggcgacagacagaccggtaagacgtcgatcgcagtagataccatcttgaaccagaagggaaaagatgtgatctgtatttatgtggcgatcggtcagaaggcatcgaccgtagcaaagcttgtgaatacattgacgaagaatgatgcgatggactactccatcattttatcatcgacagccagcgagtcggcatcgttacagtacattgcaccgtatgcgggaaccgctatggcagagtatttcatgcatcagggcaaggatgtcctcatcgtatatgatgacctctccaagcacgcagtggcatatcgtgcactgtcccttttgctggagcgttctccgggacgtgaggcttatccgggagacgtattttatctgcattccagactgctggagcgttccagcaagctttccgatgagctgggcggaggttccatcacggcgctgccgatcattgagacgcaggcgggcgatgtatccgcatacattccgaccaatgtgatctccatcacagacggtcagatctttttggagagtgatctgttcttctcaggtatgcgtccggcagtcaacgtcggtctctccgtatcccgtgtcggcggtgcggcgcagaccaaggcgatgaagaaagcgtccggtacgatccgtattgatctggcgcagtatcgtgagatggaagtgttcacacagtttgcatccgatctggacgacatgacaaaagagcagttacagcacggaaaatgcctgatggagctgttaaagcagccgctctgccatccaatgagcctggcggatcaggtcatcacgctggtcgctgccaacaagcgtctgatgctggacgtagacacggcaaagacgaaagaattccagctgggtatgttagattacatccatgtacagcacgcggagcttgtgacgaagatcaacgaggaaaaagtgctggatgatgcgattacggagcagattgtagaggcggttaaagaatataagagcaggtgatagagcatggcaaataccaaggaaattcaaaagcgaatgaaaagtatccgggataccatgaagattacaagcgccatgtatatgatatcctctgccaaactgcgcagtgccaagcagaagcttgagcagacggaaccttatttctatgcacttcagggttccatttccagattcctgcgccacattccggaggtgcagaaccgctatttcgaccagaagaaggagattccggaggaagaaaagcggcgtggatatatcgtgatcactgcggataagggtctggcaggagcatacaaccacaacgtcatcaagatggcgcatgagcttttcacgcagggcgagaacaataagctgtttgtcgtcggcgagctcggacgccagtattttgcgaaagagggtctcgcggtggatgcggagttcaagtataccgtgcagaacccgtcgcttcaccgcgcgcgtgtcattgcggatcacgtcatggatctgtacgcggaaaatgagcttgatgaggtatatatcatctacacaaagatggaaaactctttttctatgaatgcggagaagatgaaacttcttccgcttgtgaaggaagacttcctgcatcctgccccggcggatatctaccaggaggagatccgggtggagtcatccatggaggcgattctggagcatgtagtaccgaactatgtcaccggatatatctactgtgcgctggtagagtcgtttgccagcgagcataattccagaatgatggcaatgcaggcggcaacggacagcgcgaaggacatgatacagacgctgtcgatcgagtacaaccgggtacggcaggcggcgatcacacagcagatcacagaggtgagcggcggtgcgaaagcgcagaagaacaagaaaaagaaataaagcggaagggagcttgtatgaagaaaggtaaaattgtacaggtcatgggacctgtcgttgacgtagaatttgaagataatgaccttccatatattaaagatgcgcttgaagtggacaacaacggaaagcgctgcgtgatggaggttgcacagcacatcggcaataataccgtccgctgcatcatgctcgcggcaagcgagggcttatgcaaggatatggaggttattgccgagggcggcggtatcaaggttccggttggaaataagaccctgggcagactgtttaacgtgctcggagatacactcgacggaggcgaaagccttgacggtgaggaacactgggtgattcacagagatccgccatcttttgaagaccagagcccggtcgttgaggtgcttgagaccggtattaaggtcatcgatcttttggcaccgtatgcaaagggcggtaagatcggtctcttcggaggtgccggagtcggtaagacggtattgattcaggagctgatccgcaacattgcgacagagcatggcggatattccatttttaccggcgtcggagagcgttccagagagggaaatgacctgtggtctgagatgaaggaatccggcgtactggataagacggcgttagtgttcggacagatgaacgagccgccgggagcacgtatgagagttgctgagacgggacttacgatggcagaatatttccgcgatgaggagcatcagaatgtacttctgttcatcgataatattttccgttttacacaggcaggatctgaggtatccgcgctgcttggacgtatgccgtccgcagtaggttatcagccgaccctggcgacggagatgggcgaactgcaggagcggattgcctccacgaagaacggatctgttacttcggtacaggctgtttacgtgcctgcagatgacctgacagacccggctccggcgacgacatttgcacatctggatgccaccacggtactttccagaaagatcgtagagcagggtatttacccggcggtagatccgcttgagtccaactcccgtatcctcgaggaggacgtcgttggaaaagagcactatgagactgccagaagagtacaggagattttacagaagtacacagaactgcaggatatcattgcaattctcggtatggaggagctgtccgaggaggataagctcgtggtataccgtgcaagaaagatccagaagttcttatcccagccgttccacgtggcagagaactttaccggcgtgccgggcaagtatgtgccgcttaaggagacggtaagaggattcaaggcaattattgacggtgagatggatgagtatccggaagcagcgttcttcaatgtaggtacgatcgatgatgtgatcgagcgtgcgaaggagatgggggcatgaatacatttagtctgaaagtgattgcctgtgaccgtgtcttttttgacggaagatgtgagcaggtcgttctgccgctgcatgacggagagaaagcaatccaggcgcatcacgaaaatatggtgtttgccgttgagatcggcgagatccgcatcacggacgaaacaggcgaggagatcgtgggtgtgacaggcaccggatttgcacagatcatcaataaccgtgcaatggtgattgttgacacctgtgagtccccggaggagatcgatgtgcggcgtgccgaggaggcaaaagagcgtgcacaggagcagctccgccagaaacagagcattcaggagtattatcgttccaaagcatcgctggcgcgcgcgatgtcgcgcctcaaggtcgggaaaaaagaccgtccgaccggatattaagaagaaaaatggtcttgtgcaaggttccggcgggtctgagagagaaaaaacgtctctccagacccgccgggaccttgttattatgcgcgtgggaagaaaaaagggctgttcgcgggtctgggaatgaaaaaccagcccgtgagacccgaaaagagattagtttcgggtctgggagaggaaaaaggtgttgccagacccggcggaagccaaaatgcagccatgtaagtcaaaaaaatagaagattgtacgcaaaaacgggtctacagagagaaaaagtcctctgtagacccgttttgatcttatgcacaacatcagcaaacaatgattgaccaagaaagctcctgtgggtgcatgtgagactcagccctgcagcttgccagccgatacaagtattaacgcacatgccgttgcaacttacttaagccccactgtagcctgtaatgcaacttactagccagccagcttatgcggtttgctcatcggtgcagattgcttccccgcgctgcttacagtacgaagaatgtacaggttgccggtgcaagagtcactgttccggcttcctgtgctgccggagtgagttccggaagagaattgccggcacccagaacaagtggcttgccatttaaagtcatgacagcggcacgcacgttgccgccctcgccggcgagtgtgtagcgctctgcgctcttcggaagctctacggtggttgtctctgtcagcgagttgttgatcacaagatatacaacgccctcttttccatctttgcgggaatgtgcgaagacatgtgcgccctcgcggagtggctctgcggtatcgtaaacggtcgtacccatcaggcggttccacaacaatacggcaaaatagttcgggcgcggatcaaatacttcgcgggccaggaagccgtagtcggaagaagccagtgtattgtggaaaataacgccgtctgtgatcgctgcgaatccagcgagctcgtttaaggtacggaaaacatccagatacgtggaagcccatgtatcaccgccaccgcctgcgtcgccggactccgttacccacatctcgccgcccgggcagtatttgtcgcggagtggagcataggtgcgcgcacagtttaatgcaacgtccagatacgcctcggtatgggcggtatctgccagccagtgtccgcttggcatcacggaagcaagacgctcggatacaccgttgtaataatggtagctgaatacgtccaacggctctttggtgtcctctaacaggtcggttgtggagcagttctctcttacaagctgctcgataccaccactcttgctgttgtcatcaccgccattgatggtaagaccctcgccaacactgctcggtccgatacagatacattccggatagttggcgcgtacccacgcgaaaaacagatcctgatcgcggtggtaatcagccggtgtataaccagccgggaagccggtatcctccatcatgttcggttcgtttgcgaactcggcgccgtcgatcggtacgccgtgttctttgctcagacgaaaaatcttctccgcctcactcggattccacggttcctctgcggaatgcagacccgggcagttcgcaacggaaatcatcagtttcgcatcgatcgcttttacgaagtcgagcacaccaatccactgctcctttgtcaggacatttaagtagccctccggagcaataccgcctgttgcattgtcaaaatcatagtaagtcttggttgcccaggtgccggacacacgcacccatgcggttccgagctcctttgcgagggagcggagcttctcgttgtacagatcgatcggtgcgtatacctgcatcagatccttgtacattgcagcaatgccgtctgcgctcggagcgacatggaattcctcggttcctgcaacctgctccggtgtgtacgctttccagaaggtgccgccggttacctcggcgaattctacattataagacatcaggcgcggatttacttcgcgcagcgcctttaaattctcgggaactaattttacaaactgtgccatagaaatcattctcctgttcgtttttatttgccggtgatccggatccccgtatcacctttgcataaaaacagcgtaccacaaaaattgtattgtgtatgcaggaaaacaactatttacaaaaattgtgcaaaaacaggacaaaatcgttcccgcccttagcgctcaaatctgccgcttgccccgcacggaagcaccagaccgttgctggaaaccggcagaccgatttcatctgcggcgatatgaccaccgtgtttttttaagacggtattcatcatatagctgagcactgccggctgaagaccagtggtgtaggagttgatcaggaaaaacagaggatcgtccgacagcaactgctcacagagctgcaccagcggatagatggcgtcctcgattttccagatctcacccttgggtcctcttccgtaggaaggcgggtccataatgatcgcatcatagtggttgccgcggcggatctcgcgctcaacaaactttacgcagtcgtccacaatccagcggatcggggcatcaccaagaccggaagagacggcgttttccttcgcccaggtcaccattcccttggaggcatccacatgcgtgacgctggcaccggcagcagcggcggcaatcgtggcaccgccagtgtaggcgaacagatttaacaccttgatcggacgtccggcgctgcggatcttttcggaaaaccagtcccagttggcagcctgctccggaaacagtccggtgtgcttaaaactgaacggctttaagttgaaagtcagcttgccgtaatggatggtccactgctggggaagatcaaaaaattcccactccccgccgcccttggcgctgcggtggtaatggccgttcattttgcgccagccgcgctcggtcttcggcgtgtcccagatgacctgcgggtcgggacggacgagaagataatctccccagcgctcgagcttttctccttttgagcagtcaatgacttcgtaatctttccagttatctgcaatccacatagcaatctccattcctgtgtacttctaatttaaaactataacaaatatataccacaagccagcagagggcaaggaaaaagtaaaaatgtctgcctgcgggcagagaaaaagccttcgccacggcgcggcgcaggcattaacggatgcggatacagcatccggagcaggaaaaagcccataaaaagccaataaaaaaccggtagaaaaatatctaccggttcaaaactgcgcagcccaaattgccggctgcacgttattttttacgccaggtggacggcatgaacagaatcatgagcgggaaaagctccagtctgccggcgagcatgtcaaaaatcagcacaaccttggagagcggcgagaagatcgaaaaattctgcgccggtccgacacggtttaagccaggaccgatgttgttcagacacgagacgactgctgtaaagttcgtggtaaaatcgaactcgtccaggctgatgataagcgttgacagcatgagcaaaataaagtaaatgaccagaaaaacattggtagagcgcagggtgctgtgttctacgacatgtccgtccatgcggatcttgcggatctcgcgggggtggataatcagggaaagctctttgcggatggttttgaataaaatcaccagccgggatactttcataccgccgcctgtgcttcccgcacatgcgccgacgaacatcagcgtcacaagaatcgtctgggagagcgcaggccacatgtcgaagtcggcagtggaatatccggtggtggtgatgatcgcaccgacctggaaaaaggcattccgcagcgcgtccctggtatttgcgtaaagcgggcgtatattataggtaatcattccgacagaagcaaagatcaaaaagagataccagcgcacttcctcgatgcggaatgcatccttgattctgcgcgataaaatacaaaaataaaatgtgtaattgataccgcttaagatcataaaagttgtgaccgtgttctggatagcaggcgaaaagcttgcaaagctgtcgttacggaaaccgaaaccaccggtgccggtcgtgccgaaactcgtcagaagagactcaaacagcggcatgccgagcgcacacagaatgacaatctcaaggagcgtgatggcaaggtaaatgccgtataatattttcgcggtatccttgatgtgcggaaccagacggctgacggaaggtcccgggctctccgccttcatgaggttgatcgtagagccgcccatcagaggcaggatcgacataataaagacgaacacacccatgccgccgatccagtggctgaaactgcgccagaaaaggctggcatgcgacagggactcgacatcagagagaatacttgaaccggtcgtggtaaaaccggagaccgtttcaaacagggcgtctacataatatggaatgtcgccgttccacacgaaggggatagcgccgaaaatactcataacgatccagctcaaggcgacagtaacaaacccctcccttgtatacacggtcgaggaagacggttttttatgtgtgaaaacaatccctaaaaccagacagattgcagcggtaatgacaaatggaatgccggcctcctcctgatagatcagcgagaccagcgccgggagcatcagaaacgcgctctcaaattgtaaaatatagcccagaatatataaaaccatggaataattcattgcaggttaatcctccagaatctctttgatgtcggagatgcggtatccggaaatgacgaccagaacggagtctccggcgagcatcatatcctgtccacccggcagaatgaccttgccgttgcggtagatgcagcagattaaggtgttcttccggaaattcagatcctgcagcggaatgcctgcgacggcagaattctccttgatgatgaattccagagcctcggcttttccgccggcaagcttgtaaagcgtctccacgttgctgttgatggaattcactgtggagcgcacatattttaaaatgtaatcagcggtaatgacacgcggataaataatacttcccagattcatctcgttgatgacggagttaaagctgctccggttgatcttggtcaccgtttttgcattggagacatcgttggcgtacagcgacagcaggatgttttcctcgtcaagaccagtgagagctgcaaaaccctgcgcctgctccaagccctcctcggacagcagatcctgatcggtggcatcaccgcagatgattgtcgcctccggaagcagctcgcttaaaacgtcgcagcgggacggattgatctcgatgatcgtcacacggatgcccgactggatgagaatctttgcgaggtaaaaggaaaccttaccgccgccagcgagaatggcattgccgacgcggttcttgacgatgccgatcttacggaaaaagtcaatggcgttgcggcgctcggaagcgattgcgacggtatctccggcgcggaattcaaaatcaccgttcgggatgatgacctcgctgccgcggatgacggtacacaccagcacgttgctgtgcagggtctggtgcagattgaacagctttaaatgaatcagcggggaattctcgctgactttaaagtgaagcagctctacatgcccctttgcaaaagaatccacacggatggcggaaggaaactgaaatactcttgaaatctcgttggctgccgtcaactcaggattgataatcatggcgagcccgaattcctttttcaggaaggcgatctcgccgttgtagatcggattgcgcacgcgcgcgatggtctggcagtggccggtcttcttggcaatcacgcagcacagaaggtttttctcatcatctccggtaactgcgattaaaagatcggcagtggcgatgcctgcctccagcagtgtcttatggttgatgccgttccccacgatgcccatcacatccagacggtcggtaatatattgaaccttttccggcttttcatcaatgacaacaatattgtgatcttcgttgctgagctgttcgacaagcgtaaaaccaacttttccacagcctacgataataatgtccatagaaatctccttaaagaataatcaaagacattatagcatatacaaattgtttttgggaaaaaaagcgtagaaattggcaaaatcttaatgataaaaacaattttttcaaggaaacgcccgcgtggacagttcttgtgttttaaatgagggtacgttacaatgagtgacagagaactaaatgacaggagaggaaagaggagtttatgctggaacaattagtggagtgtgagaaccggcttttagaggaacagagacggttcaatgagttactgcttgcctggcggtccggggatctgggggacgatcttacacggatgaagattgagcagatgcagcgggaagtggatgcgctgggacgacagctgacagcgctgcgcacagtaattgcggcacaggcagaccgcgaacgggcgggataccgtcagggggcgatgccgaaggcggcgtatggatggccggcgtatggacaggcggtggcagcggcgcagtcgtggaatcagacaatgccgcagccggcagtgcagacagcggagacgggaaatccgataccgccggcgccgggcgcaatgtcacagtccgcgcgggagacgggaaacccgcagcaggcgtatcagcagacaccgccgcggccggtggcagcacaggcgggataccagcaggcatccgggaagcaggatctggaaaaaacgatcggcagggcgattctgccggtctgcgctgcaggactgatcttcctgagtctggtgttttttgcgatgctggtgctgccgtatcttagccagggagtaaagatggttctgatgtataccgtcagtgccgcgatcacgctggcaggaggaattcttgtggcacatgaccgcaggaataaagcatttcttgggctgctgggctgcggcatgggagcgtggtatctctcgctgtttttaagtgatttttatttccatgcaataaacgacggcatactttatctgggactgctggtgtgggcggtggttctgtgtgtgctgtcacgtctgcggtcgaatctcttccttatcatagggcagattggtgtgggcatctcattgattctcggcgtgctcatgtgtaactggacggaggatgcggaaaggtttctgattctttctatatattatgcggtaacgcagaccatctttttcgtgtcccacctgcggagagaatattaccgcaatgcggtgaatcttgtgtcgtggagcatcgggctgctcattctggtgcttggagcagctgcttcctatacagaaggctccgctgcgggaaacgtgtcagtggtattgcttcttgcgcttgcagcggttccggtactgcttggcgtagccgcggcggaaatggacgagaatggaaaactgcttggcggtattgtgggggcactgtgtatcatcattttttgcggactgtttttgaaccggtttaccggagcggcgctgctcttactggtatttggcattgcagttctggcgctgctggaattccggcggcccggggatctgtccgcggggacggttctgcttgaggtggctgtttttgcgcagatgttctttgcgggagttgccgcgccgtatttcggagagtatgtatcgacgggacttctggcggaggcgtgccttctgtacggtttcctgcgaaaaagaaaagcataccgggcggctgcgctcggctatggcatcctgctgttgctgatcccgatgaacgggggcatgagaacagtctggggactggtattcttcggcagcgcggtgctgctgattgggttctgcagggaacagtatgaaacctggatgaagatctgtggttatctgatgtttttggcattcctgtcagaaacggcggtgtggggaacggatctggcagcggtcgcagatgtttacctgagcgatctgatctgttttatgccgattgtgctctgcaatattctggcggcgaaagttccgctgtttcgcagaaatccaaagacgggagaggaagaaaaagcattcgcggcggtaacgatggccgtgcaggcgctccttattgcagcggttctggttctgatgggaaaaccggacgcgccggtgcttcaccttatctatatgcttttgggactggtgctcgtgtgcaccaatacctacagcctgctgataaggaaggacggagactggtggggaatttacgtggcgttaaagctgctgctgtttgcatcggtcgcactgcactcctatggggtgcccgtgttcgtgaacgatgtgacgggcattgtgattgcgttctgctgtatcgtggcgggatttctggcggaaatgcggatgaagagaaaatataaggcgctgcgggtctgcggactggttctggtgctgctgtgcgttgtaaaactggtgctcgtggacatccgctacgacaatgtgctgctccgggcggcgggattttttgtcggaggcatcctttgctttggtatcagtcttgtatacaatctggtcgacaagtggatggggcggcgcgaaaatgcaaaaaactgaaaaaaatccttgcaattcgcggtttcatcgtgtatactatgcattgctgtgacattgatagcgttgaagcgtgaggttgctgcagagcattgcaggttttccgtggagcgaatgtcaagttaggaaactggcgacaagtcactgtatcacgaatagaatttgtccgaaggacagagggatggcgtgtaggaagcgcgggcttctttgtgggcgtgagtccatgatacacgcgggtatgtgtgcagtcaccgcttgtcgtacaaaaagcgattacatcgcttgtaaaagtgcgaaaaggaggcgactttttttatggcaagtcaagtaatgagaatcactctgaaggcttatgatcacaagttagttgattcatcagcacagaaaatcatcgaaactgtaaagaagaacggatcacaggtgagcggaccggtacctcttcctacaaagaaggaagtagttacaatcttaagagctactcacaagtacaaagattcccgtgagcagttcgagcagagaactcataagagactgatcgatatcgttacaccgacccagaagacggttgatgcattatcccgccttgagatgccggcaggtgtttacatcgatatcaagatgaagaataaataatttcttcatcccagacaaatcaatgatttagttaatatcctgaagggttttatatagaagtaatgcaggcggtgaaaacttcccattccacttatatggactttctaggatgaacggttccgctaccccacatggttgggcatgaagcgttccgctgtagagaaaacaggaggtaaaagtatgaagaaagcgattttagcaacaaaagtcggaatgactcagatcttcaatgcagacggtgttttagtaccggttactgtattggaagcaggtccatgttctgtaacacagatcaagacagtagagaacgatggatacagtgcagtgcaggttgcatttgctgacaagaaagaaaaggttgtcaacaaggatgcaaacggcaagaagcaggtagctcacagacatggtgtaaacaaggctcagatgggacattttgcaaaggctggcgtatccggcaagcgttttgtgaaagagttcaagtttgagaacgcagcagattacaatcttggcgatgtgatcaaggctgatatctttgcagagggcgacaagatcgacgctactgcaatttccaaaggaaaaggattccagggcgctatcaagagattgggacagcacagaggtcctatggctcacggttccaagttccatcgtcatcagggttccaacggtgcgtgttcctcaccgagccgtgtattcaagggaaaaggaatgccgggacacatgggaagcgtacaggttactacacagaaccttgaaatcgtaagagttgacgcagagaacaacctgcttttagtaaaaggtgccgtaccaggtgctaagaagtgtttagtaacagttaaagaaacagtaaaagctggtaaatagtgctcgaataggaaaggaggaactaaacgatggctaaagtagctgtttataatatggaaggcaaggaagttgacagccttgaattgaacgatgctatcttcggagtagaagtgaatgagcatttagtacacatggcagtccttcagcagcttgcaaacaaccgccagggaacacagaaggctaagacccgttccgaagtacgcggtggtggtagaaaaccatggagacagaagggaaccggacatgcaagacagggttcaaccagagctccgcagtggacacatggtggcgtagtattcgctccggtaccaagagattattctttcaagctcaacaagaaagagaagagagcagcattaaagtctgcacttacttcaagagttgctgagaacaagttcatcgttctcgacgagttaaagcttgacgagatcaagaccaagaagttcgtagaggttatgaagaacttaaaggttgagaaggcacttgttgtattgaacgatatggatgtcaacgtaatcaaatccgcagacaacgttccgactgtaaagactgctcagacaaatgagctgaacgtatttgacgttctgaagtatgatacggttgttgtaacaaaggacgctgtaaagacgatcgaggaggtgtatgcataatggcaaacgtacagtattatgatgtaatcctcaaaccagtagtaacagagaagagcatggcagcaatggctgagaagaagtatacattcttagttcacccggaagcaaacaagtccatgatcaaggaagcagttgagaaaatgttcgagggaacaaaggttgcaagcgtcaacaccatgaacatggacggcaagaacaagagacgtggaatggtaaccggtaagactgccaagaccaagaaagctatcgtaacattaacagcagacagcaaggacatcgagatcttcgctggactgtaagatgaaaagcgtttcattctgatagcaaactaggcgcagcgatgcgcgataacaaacatcgaaaggagaacaacaatgggaattaagacatacaacccatatacaccttccagaagaaatatgactggctccgatttctccgagatcacaaagacaacaccggagaaagcgctcactacttctttaaagaagaacgctggtcgtaacaatcagggaaagatcaccgttagacatcacggcggtggaaacagaagaaaatacagagtcatcgacttcaagagaaacagcaaagacggaattccggcaaaggttgttggtattgagtacgatccgaacagaacagcaaacatcgctctgatctgctacgcagacggcgagaaggcatacatccttgctccggcaggactcacagatggcatgactgttatgagtggtgctgctgcagaggttcgtgttggtaactgcttaccgctcgagaatatcccggttggtacccaggtgcacaatgtagagcttcatcctggcaagggcggacagatggttcgttccgctggtatgagcgcacagctcatggcaaaggaaggaaagtacgcaacgttaagacttccgtccggcgagatgcgtatggttccgttaaactgccgcgcaaccatcggtgtgattggtaatggagatcacaaccttgtaaatatcggtaaagcaggacgtaagcgtcacatgggtgttcgcccgactgtacgtggttctgttatgaacccgaatgaccatccacatggaggtggtgagggccgtgctccgatcggacgtccgggcccatgcacaccttggggcaagcctgctcttggtcttaagaccagaaagaagaacaagtcttctaacaagatgatcgtaagaagaagagacggtaaggcgttgaaataagtttcaaccattgataagcccatcgggtgtttgtcaaaaatatacaaataagctggaatttgaccgggagaagttgtacttgcttcttccggcatgttctgctataataaacaagatgttcgtagtccgaggaaacacacgggtgtgtgtaaggactgataatattaggaggtaaattatggctcgttcattaaaaaaaggaccatttgcagatgaaagcttactgaaaaaagtagatgctatgagcaaagccggtgacaagtctgtaattaagacatggtcacgccgttctaccatcttcccacagttcgtaggtcacacaatcgctgttcatgacggaagaaagcatgtaccggtatatgtgacagaggatatggttggacataagcttggtgagttcgttgctacaagaacttacagaggacatggaaaagacgagaagaagtcaggcgttagataagaactatttttgaaaggaggtttcatccatggctaagggacatagaagtaagatcaagagagagagaaatgaagtaaaagataccagaccatccgcaaagttatcttatgcaagagtgtctgttcagaaagcatgcttcgtattagacgcaattcgtggaaaggacgctcagacagcattagctatcgtatcctacaatccgcgttacgcttccagcgtggttaagaaactgttagagtcagcaatcgcaaatgctgagaacaattatccggagaagaattacaagttggagaacctgtatgttgcagagtgttatgcaaacaagggaccaacaatgaagagaatcagaccaagagcacagggcagagcttacagaatcgagaagagaatgagccacattacaatcgtgctggatgagaaataataaggaggtcaaacatgggacagaaagttaatccacatggcttaagagtcggcgttatcaaagattgggactctaaatggtatgcggaagcagatttcgcagatttcttagtggaagactacaatatcagaacttatcttaagaagaagttatacgcggcaggtgtttccaagatcgagatcgagagagcatctgatcgtgtaaaggttatcatctataccgcaaagccgggcgttgttatcggtaagggcggcgctgagatcgagaagatcaagggcgaggttcagaagttcacagacaagaagttggttgtagatattaaggaagtaaagagaccggaccgcgatgctcagttagtagctgagaacattgcattacagttagagaaccgtgtttctttccgtagagcaatgaagtcctgcatgggaagaaccatgaaggctggcgcaaagggtattaagacatcctgctccggacgtcttggcggtgctgatatggctcgtacagagttctactctgagggtacgattccgcttcagacacttcgcgcagatattgattatggattcgctgaggcagacactacttatggtaaggtcggcgttaaggtatggatctacaagggcgaggtacttccggtaagagcgaataaggaagggggagctaactaatgttaatgccaaagagagtaaagcatagaaagcagttccgtggttccatgacaggaaaggcaaccagaggaaacacaatcacctacggtgagtacggtattgttgctctggaaccatgttggatcaaagcaaaccagatcgaggcagcccgtatcgctatgacaagatacatcaagcgtggtggtaaagtctggatcaagattttcccggagaagcctgtaacgcagaagcctatgggtgttcgtatgggtaaaggaaaaggctccctggagtattgggtagctgttgtgaaaccaggtcgtgtattatttgaaatctccggtgttccggaagacgttgcgaaagaagcgttacgtcttgctacacacaaattaccttgcaaatgtaaagtagtttctcgtgcggatttagaaggcggtgtatcaaatgaaaactagtaaatatttagaagaattaaaaacccagtctgtcgcagatttgagcgcgcagttagtagaggctaaaaaagaacttttcaatttgagattccagaacgcaaccaatcagttagataatacaagcagaatcaaagaagtaagaaagaacattgcaagaattcagacgatcattactgagaaagaaaaagttgcgcagtaggattccagaaaggagaatagtcagtcgtggaagaaagaaatcttagaaaaacacgtgttggtattgttgtaagcgacaagatggataagacaattactgttgcaatccaggataacgtaagacatcctctttacaacaagatcgttaagaaaacatataaattaaaggctcatgacgagaataacgagtgcaagatcggtgacaaagtcagagtaatggaaacaagacctttatccaaggataagagatggagacttgtagaaatcatggaaagagcaaaatagttagaaggaggctacaagcatggtacagcaggaaagtagacttaaggtagccgataacacaggagcaaaagagctgctcgttatccgtgttatgggtggatctactagaagatatgcgaatattggtgacgttattgttgctacggtcaaagatgcaacaccaggcggtgttgttaaaaagggcgacgttgtgaaggctgtagttgttcgttccgtaaagggcgcacgtcgtaaagatggttcttacatcaaatttgatgagaacgcagcagtcatcatcaaagatgataaaactccgagaggaacacgtatttttggaccagtagctagagagcttcgtgagaaacagttcatgaaaattgtttccttagctccggaagtattgtaggaggatcggaatatggcaaccatgaaaattaaaaaaggcgatatggtcaaagtaatcgctggtaaagatatcaacagcgaaggcaaagtcattgctgttaacagaaaagacggaactgtattggttgaaggcgtcaacatggtgacaaagcatacaaagccaagtatgcagaatcagcagggcggcatcgttcaccaggagggaccgatcgatatttctaatgtaatgtatcttcacaacggaaagcctacccgtgttggtttcaagatggatggagacaagaaggtacgtttcgcaaaatctacaggcgaagtaatcgactaattagagagaggaggccaatcaggtgagcagactgaaagaacagtaccagaatgagatcgtagatgctatgatcaagaaattcggttataagaatattatggaagtgccgaagctcgacaagatcgttgtcaacatgggcgttggcgaagccaaagagaacgcaaagttattagaggctgctattaaggatatggaagcaatcacaggacagaaagcggttgcaaccaaggcaaagaattctattgcaaacttcaagatcagagaaggtatggcaatcggatgtaagacaactttacgtggcgagaagatgtatgagttcatggatcgtttgatcaacttagcattacctcgtgtacgtgactttagaggtgttaacccgaacgcgtttgacggtcgtggaaactatgcccttggtatcaaagagcagttaatcttcccggagatcgagtacgataaggttgacaaggtacgtggtatggacatcatcttcgtaaccactgccaagacagacgaggaagctcgcgaattattgacacagttcaatatgccattcgccaaataagtaggagggaattttaatggctaagacaagtatgaaagtaaaacagcagcgtaaaccaaagttctctaccagagcttacacacgttgcaaaatttgtggtcgtccacattctgttttaagaaaatacggaatctgcagagtatgtttccgtgagttagcatacaagggccagataccaggtgttaagaaagcaagctggtaaaagaccgtgcagcatatttgctgcaatcaataataaggaggaaatatacaatcatgactacgagtgatccaatcgcagatatgcttacaagaatccgtaatgcaaacactgctaaacatgatacagttgacgttcctgcatctaagatgaaaattgctatcgctgacattcttgtagatgagggatatatcgcaaaatatgatattgttgaagatggtaacttcaagaccatgcgcattactttaaagtacggcgcagacaagaacgagaagattatcacaggattaaagagaatctccaagccgggacttcgtgtatacgctggcaaggatgagctcccgagagttcttggcggactgggaatcgcaattctttccacaaaccagggaatcatcactgacaaggaagcaagaaagcttcaggttggtggcgaagtattagctttcgtatggtagattttgcccgccattggacggacaaaatcggaagaaccaaaggctggttcttccgagagcatcttccgggagcatctgtctctggtctgtccagaagcaatgttgctttcggttcttccgggttacttaacctggaggaggttcttaccgaatcgggtaactacggcgcaagccgcaatgatataagcacaaattaggaggtacgggcatgtcacgtataggaagaatgccaatcgcagttccggctggtgtaacagtggatattgcagaaaataatcatgtgactgtaaaaggtcctaagggaactcttgagagaacccttccgtccgagatggacatcaaattagagggtgacgaagtaatcgttacaagaccgaacgatttgaagaaaatgaaatccttacatggattgacaagaacactgatccacaacatggttgttggtgtaactgatggatatacaaaggagctcgaggtaaacggtgttggttacagagcttccaagtctggaaaagtccttactttaaaccttggatactcacatccggttgagatgaccgatccggagggacttgagtccaaagttgatggaaacaagatcattgtatcaggtatcgataaagagaaggtcggccagtacgcagcggaaatcagagataagagaagacctgaaccgtataagggcaagggtatcaagtatgctgatgaagttatcagacgtaaagttggtaagactggtaagaaataattaaaggagtgacgaaaaatggttagtaagaaatcaagaacagcagttcgcgaaaataagcatagaagaatgcgtcatcatctcgtaggcactgcagagagaccacgcctggctgtgttcagaagtaataatcatatgtacgctcagattattgatgatacagtcggaaatacacttgtttctgcttctactcttgagaaggacgtaaaggcagagttagagaagacgaataacgttgaagcagcagcaaagcttggtaccgttatcgctaagaaagcattagacaagggtatcaacacggttgtattcgatcgcggcggtttcatatatcagggaaaagtgaaagctttagccgatgcagcaagagaagctggattagaattttaataggaggaaacgcaaaacatgaaacgtgaaattattgatgctagtcagttagagttagaagaaaaagtagtgtcaatcaaacgtgtaacaaaggttgttaaaggtggacgtaacttccgttttacagctttagttgttgtcggcgacggcaatggccatgttggtgcaggtttgggtaaagcagccgagatcccggaggcaatccgcaagggcaaagaggatgctatgaagaagctcatcacagtaaagctggatgaggttgacagtatcacacatgatgttattggtaagcacaccggtgcttccgtattattaaagaagtctccggatggtactggtatcatcgctggtggtcctgcacgtaacgtatgtgagcttgcaggtatcaagaacatccgtacaaagtctttaggttcaaacaataagcagaacgttgttcttgcaacgttaaacgctttgagccagttaaagtctccggaagaagtagcgaagcttcgcggtaaatccgtagaagagatcgtaggttaaggaggaatttaagatggcagagaagaaacttaaagttacacttattaaatccacgatcggtgcagttccgaagaacaagaagactatcgaagcactgggactcagcaagctttacaagactgttgagcttccggacaacgctgcaacagcaggcgcgcttcgcaaggttgcaccatatgtgaaagtagaagaagtttaaaataagaggataaggaggtgtcggtaatggacttatcaaatttacagggagcggcaggttccactcagagtgataatttcagaagaggacgcggacacggatcaggaaatggtaagactgctggtaagggacataagggacagaaggctcgttccggagcaccaagaccaggtttcgaaggtggtcagatgccattatacagaagattgcctaagagaggtttcaagtgcagaaactccaagacaatcatcggaattaacctttcagctcttgaggcattcgaggacggcgcagttgtatctgttgagacattgatcgaggcaggcgttgttaagaatccaagagatggcgttaagatccttggtaatggcgaacttactaagaaactcaccgttcaggcaaatgcattcagcgcaagcgcaaaagaaaaaattgaggctcttggtggaaaagcagaggtgatctaatgctagagacactccgtaatgcatttaagattaaagatattcgcaaaaagattatttttacatttttgatgttaatcgtcatcagaatcggaagctgtcttccgattcctggtgttgacagtgatgtatttgcgaactggtttgcaagccagaccgcagatggaatgggattctttgatgcaatcacgggaggttctttctacagaatgtctatctttgcattgaacattaccccgtacatcacgtcatccatcataatgcagcttcttacaatcgcgattccaaagttggaagaaatgcagcgtgacggagaggaaggtcgtaaaaagatcgcagagatcaccagatatctgacggttgctttagcgctcatcgaggcggttgcaatgacaatcggcttcagaagaggcggttatctggaattcagcagtggataccagggtgttcttgatattatcatggttatcttcacattgacggcgggatctgctgttcttatgtggattggtgagagaatcacggagaagggcgttggaaacggtatttccatcgtacttactatcaacattatctcccgtatgccggatgatattaagacgctgtatgatcagtttatttcaggtaagaatgtaccgaaagcaattcttgcggctgttatcattcttgcaatcattgttggaatggtactgtttgttgtatacttacagggcggcgagagaagaattccggtacagtattccaagaagatccagggaagaaagcaggttggcggtcagtcaacatacattcctctcaaggtaaacaccggtggtgttatcccggttatctttgcacagtcactgttgcagacgccggtaatcattgccagtcttcttggcaaaggaaatggaacaggtattgggagcaagatcttaagaggtatgtcacagtcaaattggtgtaatccaagcgagccgatttattcgatcggactggttgtatacatcgtattgatcattgcgtttgcatatttctatacatcgattacgtttaatccgttggagattgcaaacaacatgaaaaaagcaggcggatttattccgggtattcgtccgggtaagccgaccagtgattacctgaaccgaatcctgaattatattgtctttataggtgcggttgcactcgcgttcatcgcgtttgttccgattttctttaacggtgtgtttggtgcggatgtatctttcggtggaacgtccatcatcattatcgtaggtgtcgttatcgagaccttaaagcagatcgaatcgcagatgcgtgtacgttattataaaggatttttaaatgattgatccagcagagctgttggatatgggaaggaacgctggacttattttataagttcagcgttttcgcttaaaaagaaagaggagaggtattcctatgaaaattattatgttaggggctccgggagccggtaagggaacacaggcaaagcagattgcagataagtacagcattccgcatatttccacaggcgatattttccgcgcaaacatcaagaacggcacagaactgggacagaaagcgaaaaagtacatggatcagggccttctggtgccggatgagctgacctgtgatctggtgatggaccgcattcagcaggaggactgcaagaatggatttgtgctcgacggatttccaagaacgatcccgcaggcggaagctctggatgcagcgcttgttaagatcggccagaagatggacttcgcaatcgatgtagatgttccggatgagaacattgtgaaccgtatgagcggaagacgcgcatgcttaaactgtggcgcaacctaccacattgtttccattccgaccaaggtggagggaatctgtgaccgctgcggtaattcagtggtactcagagacgatgataagccggagaccgtacagaagcgtcttaaggtatatcatgagcagacacagccgctgatcgattattataagaagcagaacatcttaaagtccgtagacggtacacagccgatggaaaaagtgtttgcggatattgtggcaatattaggagagtaacatgtctgtaacgattaaatccccccaggaaatagaacttatgcgcgaggcggggaaaatacttgcaaaagtgcatgagcagctgggaaaagaattaaagccgggaatgtcaacactcgaggttgacagactgggagaagaaatgattcgaagctttggatgcgaaccgtcatttaaaggttatcagggttatcccgcatcaatctgcgtatcgatcaacgaggaggtcgtacacggaatcccgcgtgcagaccgcatcattgaggagggcgacatcgtaagccttgacgcgggtgtgatctacaaagggtatcagtccgatgcggcgagaacgcacggtgtcggtgagatctcggatgacgcgaagcttttgatagagagaaccagacagagctttttcgagggtattaagtttgcgacagcaggcaatcatctgcatcagatctctgcggcgatcggtgattatgccggaagttttggctatggagttgtgcgtgacctgtgtgggcacggcatcggcaagcatatgcatgaagatccggagatcccgaatttcagacagttccggcgcggtatcaagttaagacccggtatgacacttgccattgaaccgatggtagatctgggatctgccgaagtggtatggatggacgatgactggacagttgtcacagaagactggtcgctttctgcacactatgagaacacgattctgatcactgacggtgaaccggagatctttacgcttacagaatctgagattgcgacaggcagatggaatcagtatctgggcaggcagacagagtcatagaccggtcagtaagcgaatggagaaagagatagtatgattgaatttgcaaaatccatggcaggccatgacaggaaccatatttatctggttaccggaaaggatgagcggttcgtgtatctggcggacggcaatgtgaagctgcttgcggaaccgaagaaaaagaacagaaaacatattcagatcattcacagattaccggatgaggttctgggatgtctggaacaggaagttaccgatcttacggtaaagagggcaatcaaagcgtatgtgcgtattttgaaagagcgtgcagaatcataatattaggaggatttatttatgtcaaaggcagatgtgattgaagtagaaggaacagtggtagagaagttgccgaacgcattctttaaggtagagcttgagaatggccatcagattctggcgaccatcagcggaaagctgcggatgaattttattcgtattcttccgggtgataaagtaaccattgagatgtctccgtatgacctgacaaagggcagaattatctggagagataagtaaaaaaagaattgacttctaataagtgttcatgctataatgctaaacggacacttttggatagtgcctttttgcgcatgtagtgcgccaagaagagctatgatagaacatgagagatgcacgcgggtgcgtgccattcattgtttggaaaggaggatttgctgtgaaggtaagatcatcagttaagcctatttgcgagaaatgcaaagtcatcaagagaaaaggaagcatcagaattatctgtgagaatccgaaacacaagcagagacagggctaattgttcttgtctttttgcgctttcattatgtgcggctgcagtggaacaccaggatgagttgttcgcactgttatcatatgaaacagcagggatagctgcttttttgcgtttacataccgaggacgcaggggagaatcatccggaatacgagggaattgcgagggcacacatttcaggccggaggacaacggagctgccgcagcagattcttgaacgtaaaaagtcatgatgtcaagtggcttgcttaaagacgcggtctgtcatctggacagtcgcaggaatcagaaaataacaagatgcgcagtgtgtatcacaggcatcatatgaatcaatggaggttaaaaagcacatggctcgtatcgcaggtgtagatttaccaagagaaaaacgtgttgagatcggtctgacttatatctacggaatcggtagaacaagttctaaccgcatccttgcagaagcaaaagtagacccgaatacccgtgtcagagatctgacagatgatgaggttaagagaatcagtgcagttatcgacgagagtcagactgtagaaggtgatttaagaagagaaatcgccatgaacatcaagagacttcaggagatcggatgctatcgtggaatccgtcacagaaaaggtcttccggttcgtggtcagaagacaaagaccaatgcaagaaccagaaagggaccgaagcgtacggttgctaacaagaagaagtaattactttttcgattccgttcgtaggatcgccacgggtgaagtatggcggtcagttgcatacaatcattagattattttgagaaagtaggttagtttagatatggctaaagttacaaaaaaagtgacaaaaaagcgtgtaaagaaaaacgttgaacgcggacaggcacatattcagtcatctttcaacaacacgatcgtaacgatcacagatgctgaaggtaatgctttatcatgggcaagtgccggtggtcttggatttagaggttcaaggaaatctactccatatgctgcacagatggcagctgagactgctacaaaggcagctttagtacacggattaaagacagttgacgttatggttaaaggaccaggatcaggaagagaagcagcaattcgtgcgctttccgcttgcggtcttgaggttacaagcatcaaagatgtaactccggtacctcacaacggatgtcgtccaccaaaacgcagaagagtttaattaggagggagagacgaaaatggcagtaaataaagttcctgttctgaaaagatgtagatcccttggtttagagccaagctacttaggatatgataagaaatccaacagagagttaaagagagcgaacaagaaggtgtctgagtacggtcttcagttacgcgagaagcagaaagcaaagttcatctacggtgtattagagaagccgttccacaactactatgtgaaggctgatcagatgaagggcatgactggtaccaacttaatgaccatgttagagtccagattagacaacgttgtattccgtatgggattcgcaagaaccagaaaggaagcaagacagatcgtagatcacaagttcgtattagtaaacggcaagcaggtaaatattccttcttaccttgttaaggctggcgacgtaatcgagatcaaggagaagaacaagggtcttcagagaatgaaggacattgttgaggtgaccggcggaagactggttccggattggttagatgttgacgctgagaaattacagggaactgtaaaagaattaccttccagagagcagatcgacgtacctgttgacgagatgctcatcgtcgagttgtactccaagtaatcgtgattaggcggagacaatccaataggcaaattacccgagaaggagggattttgtagtgttcgattttcaaaaaccaaaaattgagatcgcagaaatttcagaagacaagaagtacggaaggtttgttgtagagccactggaaagaggctacggtacaacacttggtaattctttaagaagaatcatgctttcttcattaccgggtgcggctgtaagccaggtcaagattgatggtgtgctgcatgagttcagttcgattcctggcgtaaaggaagacgtaactgagatcatcatgaacatcaagaatcttgcaatccgtaataacagttctacgaatgagccgaaagttgcatacattgaatttgaaggcgaaggcgtagtcacagcagcggatatccaggtggattctgatattcagattttaaatccggatctggtaattgccaatttaaatggcggagcagattgtaagttatacatggaactcaccattacaaagggcagaggctatgtcagtgcagagaagaataagaccgaggatacaccgatcggtgtgatcgctgtcgattctatctatacaccggtagagcgtgtcaacctttctatcgagaatacgcgtgttggtcagattaccgattacgataagctgacactggacgtatacacgaacggtaccttggaaccggatgaggctgtcagccttgcggcaaaggtattgagcgagcatttaagcctgttcatcgatctgtctgaggctgcacagcaggcagacgttatgatcgagaaagaggataatgcgaaggagaaggttcttgagatgaacatcgatgaactggaactttccgttcgttcttataactgtctgaagagagccggaatcaataccgttgaggaattgacaaaccgcacaccggaggacatgatgaaagttcgtaacctgggacgtaagtccttggaggaagttcttgcaaagttaaaagagctcgggcttcagctgaatcagggagaagaataaatagaatcgagcaagctcgattcattagaagtttgacaggtcaaacttcgcgcttccgtctgaactgctaacgttcagacggtaccatgtatccgcgctaccgtctgggaagcgaatattcagaaggtatcatagtatatggcagaaacagtaagaccgaaaggcatggagtatgtcagcagccaaacgggaatgaatccacagggtttgttcctgcgcgaaatgtttcgcgcggcatcggatgagtaagaccaaaaggcatcatcggatgtaccacatcaatggaggaaaagaaaatggcaaagtatcgtaagttaagcagaacctctagccagagaaaggctttattaagaggtcaggtaacagcattattaaacaacggcaagatcgttacaaccgaggctaaggcgaaggaagtccgcaagatcgctgagggactgatcgctatggcagtaagagagaaggataacttcgaagaggttactgttaaggctaaagttgcccgcaaggacaaagacggcaagagagtaaaagaagtggtagacggtaagaaagtaaccgtatacgatgaagtagagaagaccatcaagaaagataagccttcccgtcttcacgctcgtagagagatgttaaaggttctttactctgtaacagaagttccgacagatgctgctggtaagaagaagaacaccaaggaagtagaccttgttgcaaagttattcgacgagatcgctccgaagtatgcagaccgcaatggtggttacacaagaatcgtcaagatcggtcagcgtaagggtgatggcgctctggaagtactgcttgagttagtataatcagatcgattttataaaaagagaagaaaccgctcagatgatgtctgggcggttttttattttataggaaataccgtgatacattcatgtgtgaaagtggaactttcctatgaaataaaaaacgctccgcgaggatgcgcagctcgcggtaaggaaaacatcgctttgcgaaccgctcgcgcgcggagaatctcacaagcgagattcttttttatgtagaaaataggagagcacggctttctgactgtgtaatccggtgatttcatccgatatatatataaggaataggatcgtaaaattacaatgaaggaaaaggagatttttctgtatggacagagacgacaacagaaaaatggatgaaggattgcagggaaatgagaagatcgaacaggcaatcagagaactccagcaggcaccgtctggtgaggaactggcgcatacacttacggtagtgcgcagacgcatgaaagaaggcgggcagtttattgtggcggtggaaccgccgcggggagatggaaaaattcagattcaggcaattcagacggcagatgggcagcaatggtgggcggcatttacaagcttcgaggaagaattaaaggggagtgggagcgtaatgtccacattcctttcggatatggaaaagttattcacagctgcattggggacagaagggataaacggtgttatcgtaaatccctggaaccgcacattgatgatggacaagaatctgatccagattgtgttgggaaatcaacattcctgactgtaagacccggcatttaggtccgatatatagagaaagacgttcagaagaacagggggaatgagttatggcgtttgggattgcatttgaaaatgggatcagatacgacggcaggacgggcggagaagcgcataagcccagaacagaccgcatggaaaaagaatttaagctggagacggcaccttacagtggaatggcggagaatggcatgatttgctataagggggttgtgtttacctgtgataccgagaataaccggatctgtctgggagatacgaccgatctgaagaaatgtatcaatattccgctggcgggaggcggaagtctgctggtcaacagagataatctggacgagctttccagggcgatcggaatgttttcgccggaggatgtcaagcgcattatgcaggcaatcgcacaggatacaaaggtacagcagatgcaaaaggaactggacgatgaaaagaacagcattggtaatttggcagccggtgaataaagtctggtgttgaagagttcaagagagaggagcgcgtggatgaatggatatgtgatagggttggtaatactgattgtgctggtgcttgcagcttctgcagcagcctctgtgatctgggatatcgactataagagacaggtatccggaaagagacagtttcgcaagctggaggatggaaaacgcatatcgcatgatctgcgcgagagacagccggaagatccggagatcatttatctgggatcgaagatcaaaccggatctggaactgcggcagaaatagaaagcgttcgtttacattcctgctttttaataaaagcaaggaactctgggagcggaagaggctttgaaaaatagaagccctggatgtagtcaatgccaagctgctccattgcagtaagctgctcctgcgtctcgattccctcggagacaataccgagcttcatgtcctgaatcatatgcatggcagcgttcatgacaaaacggcctttctggctgctaaaatatgcctgggtcattacccggtcaaatttgacgatctgaacaggcatctcgacaatatagttcagattagactgaccggttccaaaatcatccaatgagaagctgacaccgtaggaaatcagcttttccatgttggtaagcagtgtctgcttcatctccatagttgcggattcagtgatttccagattgatattggaaggatcaatctgataacgttccatgatgcggatatagcgctcggcaagtttttcatcggaacactgtgcaacagagagattgacttcgatgtaatgaagcccatattgtgcaagctgttcgttgcggatggcatggcatactttttcaaatacgatctcaccgatctgatgaatgcgaccgctctcttcggcagcgcagatagaatcatatatcggcagcagatctccgtgggcatcgtacatgcgcaccagtgcttcggcgcaggtaaaagccttctgccttgtggaatagatgggctgaaaaaatacttctatccggttttgcgatatggcatcgtcgattttctggatcagatcattttcggcatacatgtgtgctgcgacagaggaatccacgggaataaaacgctgcacagtctgtttgatttttgtcctgcggcaatagcgcagcagagaaaagaagtcttcctggcagggtgttaaaagacagtcttccagaaaaagaattttcagattgctgcccgaggaagctgacaggtaggtgtccagcgcaaatttttggatggaagcagtatcggcatgattccacatggacgcgggggtcagcattacgatctcatcatctgcggtcttaaaaatgtatgcaccgtcagtagacagcagtttttttgccagatcctgcattgtctgctgtgagtcgtcccccgaaaaccggtgatcattgatgaatacaaaggcagtataagcagacctgtcataatagatctgatgaatgaattcataaaaagcagtctggttatacataccgcttgcgcggtcaagattgatttcaggattttcaaattgcaggtaaatgatgacaacgccaaggcagctgccaaatcccacaaccaggatttcaggatttaaaaactggatgatcgctgagagtatccatacgagcatccagagtaacattcctgtgcgtctgcgcacacggatctgtctgcaatatttcaggatgagggcaaaattcagcaggatcagtccgaccgcaccaagatacgtcatgagtgcagaagaaccataagtgtatacgatgtgtgtaacaggatcacagtatatggaaatcggaagaagatagatggaaagacagatgacggaggtgataagcaggataaggtgctctgttttccggaaggctttgttggagagcagaatatccacgccgatatacataacaccgcataaagcggtcagcaccagggtgataaggtaggttttgcacacaaatgttacaaagagtgcaggcagatgggaagcagattcaattgcgacaatggaaaggatgtccatcaggatgcataacaccgtgaccgcatagaaacgcaaaaaagcgcgccgcgaatacgtctgcaacgtgtgctgctgatggtagagcagatatagaatcactaataaaacaaatccacatgcctgtacttttatattcataactccattacctcattcgtatagaaacatctatgtaagtggctttctccctgaatttatggtatcatatatggaagcggatgggaacggaaaatctgtggacttgatagaaaatgacggaggttttctcagaatattatagatcaggaggaagcagatatggacatgtccctgcttcagacaaaaatgaagcctgcaacaccgctgccagaacttcagacagtggaagatatctatagatggatcgatgaaaatattgcatatggatggcaggataaagacggaggaacgcataccagcgaaatgaaagatttccggagattgtaccggacaatgtctgtgacggaaaccctgcggcagaagatcggaacctgcattgaacaggttgcacttatgcatgaactattggatgcaatcggcattccgaaccagatgtactgctgtcggatatttgagccggatgattacggaaatctggaggaagaggagcatatgcactgctttcttttgtatttccaaaatggaaaaacatatcacatggagcatccgaatgtagaacaaaagggaatttatgagtatccgacagaagaagccgcgctccggacaattacggaatattatgtgaagctacgcggtggaaaagagagtcctaccacctgtttttccggcgtgccggcaggggtatcattccgggagttcaacgcatttatcaaccatctggcataggaacggagcaatgctcggaaacacgcgctgtggcgtcaccagaaaaaggggtatgcatataatatgcataccccttttggtaaaataatggatggtgttttacttagccgaagtatctctttaagagtccctcgaaagccttgccgtgtctggcctcatctctggccatctcatgaacggtatcgtggattgcatcgaggttggcagccttagctctctttgcaagatcagtcttgccggcagtagcgccgttctctgcatcaactctcatctgcaggttcttcttcgtgctgtccgttaccacctcgccgagaagttctgcaaactttgcagcgtgctcagcctcttcgtaagcggccttctcatagtacattccgatctccgggtatccctcgcggtgtgcaacccgtgccattgcaagatacatacctacctcagagcactcgccctcgaagtttgctctcagatcagaaaggatatcttcgctgacgccctgtgcaacaccgactacatgctcggcagcccataccttctcgccttcctgaagcttgaacttctcggccggtgccttacagaccgggcagaactccggagctgcatctccctcataaacataaccgcatactgtgcatacatactttgccataattcattctccttttcttataaaaattttaattggaatcaataatagtaactgttactgattttaaactgcaaaaaaacttttgtcaatatcttttttgcaattttctgatcaggatgagcatttttcagatgccttgcaggaagggcaggcgccgtaaaaataggtaatatgcccttcaatctcaccgtcaaagtcctgaccggcaagaatgttgatatgatctaagccgctcaccgtaagatccatcacacagccgcaatggcggcagatgaaatgatagtgtggagtagggttgccgtcgaaacgatccggtccgattcccggggaaagcttctggatctcgccgatttccgcaagcagattcaggttgcggtagacggttccaaggctgatattcgggaactcccttcggatattcagatatacggtctcggcggtagggtgatcataccgggttacaagaaaattcttgatagactcccgctgtttactgtacttcagcatggatgcgatacatcctttccttaaaactagtaattgttactgatatcatcttacacgtacagaaagaatttgtcaagagaaaaataggaataattattattttttgaaaagattctatttatggaatgcgtgcatatatatgaagataaggatagaagcatcagggagtacccatggcgggaatgaagcggtttgttacatatatatatgcctatgaggaggaaaaaaagggaagcaatgtcggatttgcgagaattgagatccggggacaggatgcaagaattgagattcatctgcgcggcgtctatgcggcgtctgcggcatgcagagtgtatctgttccagcgggaagcggcaggcgggaaggaagcaacaggtgtgaccggagtactggtcggtgagatgaagctgacgaacggaagcggcgatggcgccgttgtcttaaaaggcggcagagtcggagcatctccttatggcattacagagatggagggattgttttttgtcatcggagaagagcggattctgatgagccggtggcgcgagggtgctccgtttaaggtggggctgtccggattccgggagtggcagccggatgagccgaaggagaaggcagcagagaaaggggcggcagcagaaactgcggcgcaaaaagaagtgcgggaagcagccgcggcgcaggcggaacagaacagccagacggcgacgcaagagatggcgcagagaaagcagggggagcagccccggtacagtcggaacagaacagccggatggcggcaaaagggatggcgcaggatgtgccgtccgggtccggaatggagacggcagcggcaggggaggagacggaggcgattcatgccaccgagcttcccatgcgcaatctgttcccggaatacgactggaatgccgtgtgggaggagctctgcagagaacacaaaccggcggctctgtttgaggagtgggatacgcagtgcatccagctggaattaaaggatctgcggagtctgccgaaaaaatactggtatctgggaaacaacagctttctgctacatggatttttcaattatcggtatctggtgcttggcaggacggcggaggaacggtggttccttggcgtgccgggagtatatcagagacaggagcgcgtgatggcggctattttcggtttcccggaattctttgccgccggcccggggggtgagcgcagggaaggcagggaaccggtcaaccattttggctgctgggtgcgttatattgaagagtaaggatttaaaagggcatagcggatgtggtcttcccattttccctgaatctgggtgcaggcgtattcggtgccctcacaagtgaagccgatgacttccaaaagccggagagagggagtattttccggcatcacgcgggcaaacacgcggtgcagggaaagatcggtaaaagcgatgtttaaaacctttgtcacggcttccctggcgtagccctgatgctggaatgcggcgtcgaacttgtagccgatctcgctgcagcagtacggcatgcgcagaatatcgtgcaggcagacggtaccgatgatgatccgcgggttggtttttaagaagacataaaaacggatcgatgcacatttccgtgcgagatcatactcacattttagaatggcctgctggtgcgccggagtcagaaaataggggggacgcgtcggctcatagcgttcaaagagctcacggttgcggcactggaaagccagaacctcgttcgtgtcatcaggggtcagtatttttaagatcaggcgatcggttgtatacatggtatggacaggaagactgccggtaatatagttgttgcagttcatacatactccctctgccgaaaatgttccatcgacaaaatgcatcaaatcggctaaaataagtctatactatagtatagcatttctggagaaactgtccatgacacaggaagaaaaatatatgaaagcggcgatccgcgaggcaaaaaaggcatacgcactcgaggaggtgccgatcggctgcgtgatcgtccagaatgacaggatcattgcgcggggttacaacagaagaaatacagagggaaatacgctggcgcacgcggagcttactgcgatcaaaaaggcgagcaaaaagaccggcgactggcggctggaagactgcacgatgtatgtcacgctagagccgtgccagatgtgtgcgggggccattgtgcagagccgcatgaaaaaggtcgtgatcggcagcatgaacccgaaggcagggtgcgccgggtcggtgctgaacctgcttcagatggcacagtttaatcatcaggtcgagatcgagaggggcgtgctggaggaggaatgttcgacgatgctctccggcttcttccgggaactgcgcgataagaaaaagagactgcgtgaaaacgtgtagaatgcttgacaatcgggcgtcagataggatatacttaagtctccgagcagccggggtggtagcggtaccctgtaccaacaatccgctatagttggggtgatgccgaacagaggatcaggtaagctgtaaagctgcccatcataagtggcgttgacgtctgggtcttacgcaacaggaatctgtgaaccgggtcaggtcaggaatggagcagccctaagcagaagctcttgtgtgccgtgagggtgcctgggctgagctaactgtggtggtaacgtttatggttttggattcgaagtgaggcgctcggattttgcgttttataagtgttttttataaagattctgacagataacttttgggaagagggagagataccatgtgggataaggcgagaaggatattgtaccgtggcggagagatcttagagcttctgatggcggcagccgtcgtggcagggattctggtggcaatgatcacgcttgtgccggaactggcacgctactgggaacaccggacgatagccggtgcgtttatggagtatctggatgccgtttttaacgttgtcatcggaatcgagtttttaaagatgctctgcaagccgagttcggcgaatatcattgaggtgctgattttcctgatcgcgcgtcacatgattgtgcagacgaccacgccgctcgaggatctgctctcggtggtcagtatcggtattctattctttttccggcgttttatgctgatgaccaaaccggacaaggaccagcatgtcccgaagctttttggcgtgataaaggcgtcacagagcagcgggacagcacaggcggagcacgtggatgcagagaaaaatgcagaaggaagcaaaggcgctggggaaaaatagcacattgattgacagatgcatgacggtgttgtatgctgggagttagagatgactaacaaaaagcacaacccgtcatgcatttattttcgtacaagcattgctttttgtaaaaagcgctatataataaaagcataacggtggcgcagcccgcatgaatacgggaagtaagcgcttacattaaacacattgtcaaaggagagagtatactatgttcggatttggtcagttgatcgatatcttgaagaaagatccaaagaaaattgtttttacagagggaaatgacccgcgtattttagaggcagcatccagattactggcaggtaccttcctgcacccgattctggttggtaacccggatgagatttttaaggctgctgaggagagcggattcaatattcgtggcgctgagatcattgatccggcaaactatgacagatttgacgagatggtagatctgttctgtgaactcagaaagagcaaaggtgtgacaccggagcaggcaaagggcattctgtcccaggcaaactacttcggaaccatgcttgtaaagatgggcgttgctgatgcacttcttggcggagcaacctactctaccgcagatacggtacgtcctgcattacagctgattaagacaaagccgggcaactccatcgtatcttcctgcttcattctggttcgtccgtctgcaaccggtgagaacgaggttcttgcaatgggtgactgtgccatcaacattcatccgactgaggatgagttggttgagatcgcaggcgagtctgcagagtgtgcgaagatcttcggtgtagatccgaaggttgcattcttaagctactctaccttaggctccggcaagggtgaggatgtagacaagatgcgcaatgcagcagcaaaggcaaaggcaaaatatccgtctcttccgatcgagggcgagttacaatttgatgcagcagtatccccgcgtgttgcacgtaccaagtgcccgggcaacgaagtggcaggacatgcaaacacctttattttcccggacatcaacgccggaaatatcggttacaagattgcacagcgtcttggtaatttcgaggcatatggtccgatcctgcttggcttaaatgcgccgatcaacgatctgtcccgcggatgcaacgcttccgaggtatattccatggcaatcatcacggctgcactggcataatccggacactgcacagaacaatagaatgacagtcatttgtggcatggcgtgacgctgtgccacatttttttgagggaaaaatggaagcattactttttaccagagaagatttgaaaaaactgattgtaccgctcattatcgagcaggcacttgctttgagcatcgggctgtttgacacgctgatggtctcctcgtgcggcgaagcagcggtgtcgggtgtgtcgttagtggacagcatcagcacgctgctgatccagatcctatcggcacttgcaaccggtggcgctgtggtgtgcagccagtatatcggcaagaagatgccggagagggcaaaactgtccgccggacagctgatgcttatcatgcttgtgtccgcagggacggtgatggtgctggttttgctgtcctaccgttttttgcttcgggcaattttcggacagattgatgcggacgtcatgcagaatgcggagatttattttatcatttccgccatatcctacccgtttctgggcgtctacaacgcgggagcggcgttgttccgggcaatcggaaacagcaaggtcagcatgtatacaagtctggtcatgaacgtgatcaatatcggtggtaacgcggtgctgatcttcgggcttaagatgggcgtgatgggcgcagcgcttgcaacgctcacggcgcggattgtatcggcgctggtcatggttgtgctgctctcaaggaaggacaacccgctgtgcattgcgacaccgggctgtatgaagccgcagagggatgtgatcggaaaaattttaaagatcggtattccgagcggtgtggaaaacggaatgttccagattggaaaacttctggtgtcgagtctgaccgcgacgtttggaacggcggcaatcgcggcgaatgcggttgcaaacagtgtggcgggatttgccaatattccggggattgcgatcggacttgcgatcgtgacggtcattggcagatgcataggagccggggaaaaagaacaggcgaaatactacagcaagcgtctgcttggtctggcttatgcgggaatggtgctggcggatctggcactgtttgcacttgtaaaaccaatcattgcctgctttgcgttatcggcggaagcggcacggattgccacacagcttctggtaagtttcgcggtctgcgcggcgctgatctggccgctcagttttacccttccgaatgtgctgcgcgccgcaggagatgcaaagtatacgatggaggtcagcgttttttccatgtgggttttccgcgtggcaagcagttacttttttgccggaacgatgggacttggcgtgctcggtgtatggatcggcatgtatgtggactgggcgttccgcacgctgcttttcgtgatccgctaccggcgtggcaggtggctggaaaagcgcgttgtatgacgccgcaagggaattgattcctaatattttcttattttttgataatacagtttcatttttgcgggaaatacggtagaatatcagagaaatacgttcagatgatgaggattttgaagaaatgtacaagaatatgggaaaagtaaaacgtacgctggaggaatatgtgattctgacggttgccacgctgattctggtggtgggcgtttatgtgttcaagttcccgaataatttttcgtttggcggagtcacgggtatcgcggttgtcctaagtgccgttatgccggcaactccgggaaatatcacatttatcatcaatatggtgctgctggtggtaggatttattttcctcgggaaaagctttggcatccgcaccgtgtatgtgagcgtgctgatgtctgtggggctaagccttgcggaagtgtggtttccgatggagcatccgctgacgacgcaaccggtactggaactgatgtatgcgattgtgctgccggcattcagtgcggcgatcatgttcaatatcggagcatccggaggcggtacggatattatcgccatgatccttaaaaagtatacgaagctgaacatcggaggcgcgctgtttctggtggatctggggattgtcatagcttcgtgttttgtgtttgatgcacagacgggactttgttcgctctgcggacttctggcgaagtcgctcgttgtggacaatgtcattgaaagtatcaacctgtgcaagtattttacgatcatctgcaatgatccggagccaatctgtgattttatcacgaatgagctgcaccgcagtgcaacgatctataaagccgagggggcatatgagcacaaccagaagacgatcattatcaccattatgaagcgctcccaggcggtagaactgcgtaattacatccgcatccaccagccgaccgcatttattgctatcacgaacagcagtgagatcatcggcaagggattccgcgggtttaattgatagtaaaaggagaaaggtttttatgaaaatttgggaagacgaaaggcagtgctatatccgtgctgccatggagaagaattcagaggcggagaacgaggcgctgaaggcacagctggatgcgatcgactggtctgtgttagagcagattgagcgcaaggagaccgtgaacgagcggggcgtattcgcaccgcttgaggcggttgagacggaagaaattgagcggcgcagggacgagttccgggaactcggcatcaaggcgatccgggaaggaaaagtcggagcggttcttctggcggggggacagggaacgcgtctcggactggacagaccgaagggaacactcaatatcgggattcaccgggagctgtttttgtttcagcagctcatccgtaacctgatggacgtgacggatgaagccggcgcgtatgttccgctttatatcatgacgagcaacatcaaccatgacgacacgcaggcattttttgaggagcacagttactttggttacccgaaggagtatgtgaaatttttcgtgcaggagatggaacctgcctgtgatcatcaggggcgcgtatatatggagtcccgtaccagggttgccatgtccccgaacggcaatggtggctggtttggttccatggtgaatgcagggctgctctccgacatccgttcccacgggattgagtggatcaatgtatttgctgtggacaactgcctgcagagaatcgcagacccgctgttcatcggtgcaacgattgcctacggctgtgagagcggcgcgaaggttgtcagaaaggcagcgccggatgagaaagtgggggtgctctgtaccgaggacggcaagccatcgatcgcggagtattatgagatgacacaggagatggcgaccgcgcggaaggcaaatggtgacctgctctatggatttggtgtgatcttaaactacgtcttttccgagaagcgtctggaggagatcgcggatgcacatatgccgatccatgtggtagagaagaagattccgtatatggacgaatccggcagcctggtgaagccggatgcaccgaacggatacaagtttgagacacttgtcctcgatatggtacacatgatggcggactgcgttccttacgaggtcgacagaaagcgggagtttgcgccgatcaagaatctgcacggcgtggattcgctcgacagcgcccgcgagcttatgcagggctgcggcatcgaattgtaacataaaacggacgggcttcccggcgggaagtccgtccgtttttggcgctgcagaagatttaataaatattttatggggatttaacggcgggttcatgaatgtctgatataataatacctgatgatggaaaacagacaatggaggtttttataaattggaggaacaggggaagcagcaggaaatagaaatcgaagaggtgaccgcacaggagaatgtgatcgcggtgcgggatctggtgccgatgcgtgcggcgatggatgacagcatggaacggatcgcagatatgaaggaccagttttcacagacgatcgatccgatcctgcgcatgtacaatgcggcgatgtgtgcaacgacggcaaggcttgagataatagaggacgagttcaagtaccggaagctgcgctgtccgatccaccatattgacacccgcctgaagtcggcgaagagtattctgggcaagctccagaagaaggatctggatctgacgctgtcggctgcctgcaacaacatctacgacatcgcgggaatccgtgttgtctgctcttatatcaaggacgtctatctgatccgcgaccgtctgatggcgcaggatgatgttatgattatgcagatcaaggattacatagagacgccgaaggagaacggttaccggagtcttcacatggtcatccgggtgccggtatattttatgaacaaaaagcagctggtgccggtggaactgcagatccgcacgctggcgatggatctgtgggcaagcctggagcatgacatcaaatataagtgtctgtatcagacggagacggagaatttctccgaggaactaaaggaatgcagccggctcatttacgaggcggaggagaaaatggagatcatgaaccgtacactggaagcataaggggaggcgcgggcgatgagagagaaacagaatccggtcgaaaaagaatgggcagcagttgtcaaggcagaggagcgctttctgcgccatgccatgccggcgcggacggcgggctggcaggagaagatcacgcgctatgtgccacagaagctggaggcgactctgcacaccgctttttacaaagcgtttgaactgatctttgacaagggaacgccggtgatagagaagacctgccagaaggagaaaaaggagcagaattataagatcaatgcttacgccgcagaggtgcgcgacacgagacatgccctgcgggcattcgggagagaggcgggtgccagccggaacctgaatctggcggtatcggcggtggaaggtgtcggcatgggatttttcggtctgggtctgccggatataccgctgttcctcggtgttttgttgaaaagtatctacgaggtcgcactcagctacggatacacgtatgacacgcaggaggagcagatcttcatattaaagctgatcgagacggcattgtcgcacggcgagcagcttgcccagaacaatatggagctgaatctgtggatgcgtgaggagcgtacgttttccgtttccagaaacgagcagatccggcgcacatcggatgcactggcgggagaactgctgtatctgaaattcgtgcagggactgccggtagtcggtatggtcggtggagtttccgatatggtttatcagaagcgcatcagcgattatgcagcagttaaatataaaagacgttttcttgagacaaagaggaagaccggggaagaaaagagacatccggcaggataagtttgcggatggcatgcagaaggggaagccgttattcggcttccccttctgcgacaatatcctcaagaacatgaatcaggtcatacatgttgttgagacagacattccgttccagaatcagatttttcagatcagcagacagggtatcaaaccggtcgcggatctcgggagatacataagatgccataagattacctcactttttcatacttcagaaaaagtatgagcatccggagagctttttatgtgtaaaaaatgccgtaaaggtggtatgatagtggagaaaaagtggaatggaataagagtatgaatgagaaaatttactgccggatcaggcgtgtgcgcgcggtatttctgacatttttcctgacggcagcagttgttttgacagacgcacagaacatccgggaaaaggaatacgaaaaaacagagatcatatactgtattggggacagtatcacatacggcagcggtctggaggatgaggaacggctgacgaagtcgtatccggcgcagctaggaatccggcttggcccgcgctacctcattttcaattacggcgtgagaggagcaaccctgcaggatctttcccgtaaaagctaccgcaacatggggtatctgaacgtgatagaggcgcagtccccggatgtggtgattattatgctgggaaccaacgattccaaacagaaatactgggatgcagagaggtatgaggaacagtatcttgcattgattgacgaacttcacaatctgccgggacatccgtatctgtatctgatggcaccgccggaagcatttcctgcggaggagggagagatcctatacgggattaacaatgatgtgatcggaggagagatccggaaccttgtgccggacatcgcggagcaatcgggctgcggaacgctggatctctacgcgctgacgcaggatcacccggaatatttcgtggatggaattcacccgaccgaggaaggatatgcgctgattgcgcagatggttgcggatcagatccgggcagaccggaatgcgggcgtgtggtgacgcggttaaaaaagggcttcaaaaattacaaaaaatatgatataatgaatccattcatctgaaacggagtatggcgtagtttggtagcgcgcacggctgggggccgtgaggtcgcaggttcaaatcctgttactccgattccttggcaggggcacggcaggcggagcgatccgtctggcggcttaagaaagagagagaccgtatattgcggtgtctcttttttatgtaataggaaacttcgttcctattacacaaaaacgttccgcggggatgtgcagctcgcggtgaggtacataatgctttgcataccgctggggcgcaagtgtgcggcaagcgcacactttgtttttaggaaaaaagaaaggcatagaaaaacccggcagaatcaatttatgattctgccgggttttgtgacagcggagacggcgggattcgaacccgcgtgccccggagggctaacgcatttcgagtgcgccccgttatgaccgcttcgatacgtctccgaatgaatggatcacagaggattctactgtgagacactcgattagtatatcatatctggtttattttgcaagatgctttcgcgaaaagtcttgaaataagttttttcgggagatactatttttatagcataacaggagggtaaggtatggaaaataagacacgggaagcaattcggtttgagggaagcgtgcagggcgttggattccgctaccggatgtcacagcttgcaagacactacgatgtgacgggatgggtcagaaatgagtacgatggaagcgtctcggcagaactgcaggggagacgggaggcgatcgacgagatcattgcgcgccttagggaggattcctatatttatctggacagagtgagccggcagaaactcgaattaaacgaagaggagcgggcattttccgtgcgctattaggcgctgcggcgcgctggtgctgtgaaacacagttgcaaaatggcgtcgaagagggtaatattctatatagaaaaactgcggtccggatgcggacccacagaccatgaacggatggtacgaaaagacggaaacaggaggagaagcagatgaagagaatcggtatgttgacgagtggcggagactgccaggcattgaatgctgccatgcgcggtgttgttaaaggactcagcgagaacgtggatgaattggaagtatatggttttttgaatggctataaaggtttgatttacggggactaccggctgctgacatccgcggatttctccggtattctgacgaaaggcggcacgattctcggatcatcgcgacagccgtttaagcagatgcgtgtgccggatgcaaacggactggacaaggtggaggcgatgaaggcgacctaccacaagctcaacctggactgtctggtgatcctcggaggaaacggaacacagaagacggcgaacctgcttcgggaagaggggttaaatattatccatctgccgaagacgatcgacaacgatatttacgggacggacgtcacattcggatttcagagtgccatcaatatcgccacagattgcattgactgtatccacacgacggcagcgtcccacaaccgcgtctttattgttgaggtcatggggcataaagtcggctggctgacgctttatgctggcgttgcggggggcgcggatattattctgcttccggaaataccgtacgacatcgagaaagtgattgccgcgatcaacaagcgcacgaaggcaggaaaaggatttaccatacttgcggttgccgagggagccatctccaaggaggatgcggcgctctccaagaaagagtacaaggaaaaagtggcaaagcggaaatatccgtctgtttcctacgagattgcagaccgtatattcaaggagaccggcgtcgaggtgcgcgtgactgtaccgggtcacacacagcgcggcggaagcccatgtccgtatgaccgtgtgctctgcacgagactcggttcggcggcggcaaaagcgatcatggacgagaactacggcaacatggttgccatggtcaatggcaagatcaaatatgtaccgctcggagacgtggcgggcaaattaaaaacggtcgatccgaacgaccagatgataaaagaagcaaagcggattggaatcagctttggagattaaggtgagggaaaagcatgtcatatcaggcattatatcgtaagttccgtccgcaggagtttgacgatgtaaaaggacaggatcatattgtaacaacgttaaagaatcagattaaagcagacagaatcggacatgcttatctattttgcggaaccagaggaacgggaaagacgacgattgccaagatttttgcgaaggcggtcaactgtgagcatccggtggacgggagtccgtgcggggaatgtccgacatgcagggcgattgcggcgggcaattccatgaacgtgattgagatcgatgcggcttccaacaacggcgtcgacaacatccgccagatccgcgaggaggtggagtaccgtccgaccgaaggaaaatacaaagtctacattatcgatgaggtgcatatgctttccataggagcgttcaatgcactgcttaagaccctggaggaaccgccggcgtatgtcatttttattctggcgaccaccgaggcgcacaagattccgatcacgattctatcacggtgccagcgctatgatttccgcagaatctcgatcgacacgatcactgcccgcctgcgggaactgatggatgcggagcaggtgacggtggaggacagggcgctgcgctatatcgccaaggcgggagacggctcgatgcgtgacgcgttaagccttctggatcagtgtatcgctttttacctgggacaggagctcacttacgacaaagtgctggatacgctcggagcagtcgacacagagattttcagccgcctgctcagacagatcctcgataaaaatatcacgggggcaatccagaccgtggagacgctcgtgatcgaaggacgggagttagggcagtttgtcacggatttcacatggtatctgcgcaatctgatgctggtgcaaagctcggacgatatggaggatgtgcttgacatctcttcggaaaatctggcgctcctgaaggaagaggcgtctatggtggacgccgatattctgatgcgctatatccgcattttctcggagcttggcggccagatcaaatatgccagccagaagcggattctgattgaaattgcgataattaagttatgtaaaccggaaatggaaaaagattacacgtccctggtggaccgcatcgacagcctggagaagaaactggaaaaaggtgttgtgatggcggcaccggggagtgccaggcagggcgtaggtggaagcgcgcagggggcacagggaggctcgctgcccaaggcagaactgcccaaggcgattccggaggatgtgaagcaggtgctgacaaactggggcggcatcttatcgcagcttaccggcgtgacaaagacgtatcttaagatggcgacccggtcgctcggaccgaacggggaattgatgctggtgttcgatgacaaaaacgcttacgagtacgtcgagcagaaccgttcggattgccaggacgcattaaaagcggcagcggcggatcggattggcaaagaggttgcgattctggtgaagttaaacgacacggggcatgccagtgacgaggtctatccggatctgggcgcgctcatccagatggacatcgaggaagaggatttttaaagctggacgaatcacacaatttatattatgatagatggaacagtcctaagagaaaagcaggaggaagcagacatggcaaaaagaggtggattcccgggcggtatgccgggtaatatgaataaccttatgaagcaggcgcagaaaatgcagcgccagatggaagaggcccagaaggagttagaggagaaggaagtgaccgcggcagcgggcggcggtgccgtggaagtgacggtatccggcaagcatgagataacgaaagtaaagctttccccggaggttgtggatccggatgacatcgagatgctggaggatctgatcatggcggcgacaaacgaggcctaccgtcagttagacgaattttcccagagttccatggcaaagattaccggcggcatgggcggacttggcggaatgccattctaatagaatttataactgcacctgtgtggcgatcgcgctgtacgggtgcagttttgttttatggcactgcagctttagcgggtaaataccgtctgctgataagcaaggcgatgagaagatcacgacttttgctttcaggcagaatgcatatggaaattctgttcaaaaaatgtggcatttctgcctgaaatcagtatgacgtgcttcttaacattgcttatcagcagacggcaatgtctatctgatgcggcagtgccatgaaacaagagcaacctgcgtgggggcacatggtgctcagagctttgccttgaatacctcgtcggcgggatagccgccggcgcacttctgcatgccgcgctggatgctgtcggcggaggtgccccagtccttgtccttgttgcggtagtcgtttttctcaacaaaccaggacacttctttttggagccggtcgagattgtcctgtatcatcgagaaggctttgggataaaactcttttttctcgtcatcggtcagcttgtcctcggctgcctcgatcaggtcgccgaagtgcggcaggcagaatcccctgcttttttcaaaaagtgcgcggaattcctcatttttcttatacaggtcgaaaaaagtatccagataacggccgtagatctgatggaaatggtcgcagacatagcagtcggtggtcttagcggcgatccatgcgccgagaggcgttttgggcgcattcccggatgagacatccgtgtgcttcatgcgtttgataaagctggatttgccgggcgtaaaatgtgccagctcatcgtcgagctcctggttcagcttttttaagtgtgtgcttaagatcagggcgttgccgagccggttgccgtagtcgtacatcatcttgaagtggtggcggcagaaaccggtggcgtctgttttggcacggatatcatcttccatataggcagagccgaggatgaaggagatggcatgctgctcggcctcgcgttccaggtagcagaaagggcattcgtcgtctgcgtggaaggcattcatcaaagggatggttgcaatcgtttctttcatggtaatctccgtttcttttcatacaatctgtgaataaattcagtatagcataccagaggaagaaaaatcaaaaccgccttgtaaaatgcggcgttatcaagtaatatatataaggctgcagggaaagcccggcagtgttgacaggaagtttgagggagagaatggaatactatagcagacagatcagcaagttaatacaggaattatccgccctgccgggaatcggcacgaagtctgcacagcgtctggcatttcatatcctgaatatgccaaaggagcaggtggaggagctttcttctgcgattttggacgcaaagcagaatgtgcggtattgcaaggaatgttttacgctgacagatgaggaaatctgtccgatctgcagcgacagttccaggaaccacaaggtcattatggtggtggagaacacgagggatctcgcggcatacgagaagacacagaagtatgacggagtatatcatgtgctgcacggcgcgatctcacccatgctcggaatcgggccgggggacatcaaactcaaagaactgatgcagcgcctgcaaaaggatgtggatgaggtcatcattgcgacgaattccagcctggagggggagacgacggcaatgtatatcagcaaactgatcaaaccgaccggtataaaagttacgcggattgcaagcggtgtgccggtgggcggcgatctggaatatattgatgaggtgacgcttctgcgcgcgcttgaggggcgcacggaactgtagtgaccgcatgagaaagggatgcgactgtccggcatctgggtcggacggatgacaatcagatataagaaaggaccatgacacgacatgacgaatctggaacttcaaaagacagcaaatgaaattcgcaaaagcattgtaactgcggtgcacagtgcaaaagcgggacacccgggcggatcactctcggcggcagatattttcacatatctgtactttgaggagctgaacattgatccaaagaatccgaagatggcggatcgtgaccggtttgtattgtccaagggacacacggcacccggactttacgctgcgcttgcagagcgtggatttttcccgaaggaggatctggtaacgctgcgtcacacaggatcatatctgcagggacatccggatatgaagcatattccgggcgtggatatgtcgagcggttctctgggacagggactctcggtggcagtgggaatggctgcagcaggaaagttcgacaagaaagactatcgtgtatatgcactttgcggtgacggagagatccaggagggacagatctgggaggctgccatgtgggcaggatttaagaaactggataatctggtggtgatcgtggataacaacaaccttcagattgacggttccattgacgcggtatgttctccgtacccgatcgacaagaagtttgaggcgttcaatttccatacgatcaacatcaacggaaatgattttgacgagatccgtgcggcttttgcggaggcgcgggcgaccaagggaatgccgacggcgattatcgcaaagacattaaagggaaaaggtgtttcattcatggagaatgccgttgactggcacggaaaagcaccgaatgatgatgaatataagatcgcaatggaagatctggaaaaggcaggtgcagcattatgtcagaattaggaaagaagattgcaaccagagagagttacggcaacgcgctggtagaacttggaaaagagcatgaagatctgatcgtgctggacgcggatctggcaggtgcgacaaagaccggcatttttaagaaggcatttccggagcgccactgggacatcggtattgcagaggcgaatatgacaggaatcgcggcaggtcttgcaacctgcggaaaagttccgtttatcagttcttttgcgatgtttgcggcgggcagaaattacgagcaggtgcgcaactcgatcggttacccgcacctcaatgtgaagatcggagcgacccatgcgggaatctccgtgggtgaggacggagcgacccatcagtgcctggaggatctggctttgatgcgcgcgatcccgggaatggtcgtgctcaatccggcggacgatgtggaggcgcgtgcggcagtgcatgcggcgtatgatcacgtgggaccggtgtacctgcgttttggacgactggcggttccggtatttaatgacgaggcgacctaccggtttgagatcggcaagggaattgtgttaaaagagggaaaagatgtctcggtatttgcaacaggattgtgtgtgaacgaggcgagagaggcggagaagcttctggcagcagacggtattgatgcggagattatcaacatccatacgatcaagccgctggatgaaaagctggtacttgcgtccgcagcgaagaccggaaaagtggtaacgatcgaggaacattccgtgatcggcggactgggaagtgccgtatgcgacatcctttctgagaagcagccgacgaaagtcatgaagatcggtatcaacgatgtgttcggagagtccggtccggctctggaactgattcaaaagtatggactggatgcacagagcatctacgagaaagtaaaggcgtttgtaaaacagaattagagaaaaacgcagataaggccgcggggattgtagcttccctgcggcttttgtaatgccgggaaagattttggcagaagagacggaaggctgtcgaaacattttttcggacaagcccataatatttcaaaatatgcagagggcttgtggtacgatttccccgagaaaaggttgtaaaatccatgtgcgtgtattgcgcggatgcgcagccggatgcggaaaggggaatcgtgtggcatgatagagattattcaccaggaacagacggaagagaaggtacagagggaactgccaagagaaatcaaacagatcgggtcgccggatgcaggggaacggatttatgtggaagataccgtgtaccgcagaatgcatccgcatggcggcgtggaagaaaaaacggcatatgtgctgctgggaaaatttgagaactgcatgggcagagagtgcacgtttgtggaagcggttattccgttgaatgaaatcctgtttgaccgggatattccggtctgggacgatcacacgtgggcgtacatatataagcagttaaagccggagcatgatccgttcgtgattgtaggatgggcgctggatatcaagggacagctccccaatatgacggcgcacctggaggcgctgcatcaacggaacttcggtggaaagcgccagattctttttctgatggacagcctggaatgtgaggaggcggtctacggcagccggaacgggcacctgtacagaagagatggattttacatttattaccagcacaggcaggtgccagaggagaacgacctctggaaaaaagaggaaaaggaattttaccgggaaatggatgtggaaggggaagagaagccaaaaccggcagtgccagtaagcgccggggagcgggaagtggcggcggacatggcgaaaatgccggaaaatgaggaaggtacaggggtgtaccgtggtctttaccgcaggagagtacagcaggatgccggtcggcaggaaaagcaggaaagacccgcgtatgcagccacagttctgctgggggcggttgtgtgtgtgcttggtgtgaccgcatatctgaatcatgaaaagatggtggatatggaacagacgcttgcgcagatgaagggaacccggtatgtgacagaagcgcagacggcggacacggagacggaagagacggagcggatgccgtctgtggcggtagagacggtgatggggaatgtcgaaaaacaggaactgtctgcggaagcggcgggaacgcaggaagattctgcggcgcagcaggcggagacggcgcaggaggcacagggggcacaggggacagcagagccagcggaaaatgcaacggcaaatgcagcagcaggaactgcagcgggatcggaaactgcgggggatacggcggcagccggtggacaggcatgcgcagacgcagcgggcacgtcggtggaggcgcagacgcagagcacgccatccacggacggggacccggcggcggtacagacccagggcacgacgacagctgccggaaactcatcggcggagaatgtgcaggcggcagcagtgcagaccgaggcgcagatgtatctgtcgcagggatattatgatgtgcagaagggagacagccttgtgggaatctgccggaaaatatatcagacaacggcaatgctggacaagctctgcgaggtcaacggcattgaggatgaaaatgccatctacgccggtcagcgtctgattctgccgaattaaaaaaatagtgaaacgggaatacacacatgctataatattcataatcagtgaaagcatagacaacataggaacgaggaagtatggcagaaaaaaacaaaagcggatttcatacggtaggggataccgatatggaggaatataaccgtaaaataaaggaacatcgcagaaaggtcctgcgccgcatcgtgattgtgacggcggtcattcttctggtgctgaccggtctgggactctacatggcgctccgccattatgagaactatgacattatgtcaaccgcggagcggtcggatacggatgcgacacattttacggaatttcagggaaatattttaaaatacagcaatgacggagcattttatctggatgccgcgaatgaactgatctggaaccagacgtatgagatgtcgtcgccgaagctggatacctgcggaaattatctgagcatctacgacaagggcgggacaaaaatttatattttaacaccgacaaagcttgtgggaagcattgagacaaccatgcagattcagcaggtatgcgtggcagagcaggggacggttgcggttctgatgaaaaaagacaaggcggcgtaccttgcgctgtatgacagagagggcaacagcctggcggaaggggagatccacggccagaacgggggatacccgatcgccattgcgctttccaatgatgcggtaaagctggcggtatccatgatcaatatcaatgaaggaagcgtcaagagcacaattgcgttttacaattatggcacggttggtcagaacgaaatcgatcactgtgtgggagtgaacaattacgatgatatggtcatcccggagatggagtttacctccaacgaccggatggttgcgttcggcgatacgaaagcagtgatctttgagggtgcgcagaagccgcaggcaatcgcggagatcccgatggatgagaagacaaaaagtattttttacaatgagcactatatcggaatcgtgaccggcaatgaggatgaggcggtgacaaatcatctggcggtgtatgatgaaaacggaaaactggtcatggaaaaggatttcggtctggactacagcagtatcgaatttttgaccaataatgagatctgtatccggaacgcaaatgtctgcgacatctatacggtgcacggtgtttataagttccaccatgagtttgaagaagaactttttgagattataccgggaaaattaaaattgaactacacgcttgtgctcaaagatacgacacagcggatcagattaaaataaggaggagattatgaactgggtattgatgcttgtcctcctggtgttggtgtgctgtgcaatctacggctacacaaaaggatttttaaggattgttttttcacttgtcgcatgggtgattgtgctggtgtttgtctcgtgggcaacgccgcatgtcagccagtggatacaggagaatacaactatttacgaaaaaatagaagctgcgtgtgaggaatctgtgcggcgtgcggcgcagggaaagatggaagaaggcgcagtggaacagtacggagaagccggggaactggggctggatcttccggaatctgtgatggcgcagatcgtttcgggggcttccggcgcagcggacactgtgcttgcggagaccggggtatatgcagggatcgcgcagagcctggcaggatttatcgtgcagggaattgcgtttgtgacggtgctgattctctcatggattctggtgcatgtgatttcggcgctgcttggaattgtatcgcatattccgatattaaaaggcgtgaaccgtttcacgggaatgttagcggggctgatggaggggcttctcatcgtctggattgcgttttacattgttgccctttgcagtacgggagagacggggagagtgattgtttcttatattaatcagagtgcgtttctgaaagaactgtatgaaaacaatattcttctgtctctgggaacgggttttgcacgctaaaaggcatgaattacaagggctgccgacagtgaggggaaaatccgtgaaaactttttaaaaaaactgtaaaaagagtgttgacaatctgagatgcagatggtagtatatacaagctgaccgcgagaacagcggacaggcaaagggcttctgaaaagaagcaaaagaaaataaaaaagttgttgacaaacggttggcggcgtggtatagtaaataagctgtcgccgagagatgacaacgatgaatgagattgaaaaatccgttcggaagttgcggagcaacttctaatgacagcgcgaagcgctggctgtacattgataactgaacagtgaataaaccttgaaagatcctaaatttcaagctgtcgatcaagagattgaaagacagacgaacgttcttataaagaacaacctaaaacagtaaattcagagtaacatctgaataagccagattattctggaaaaggaaacaaactataacatgagagtttgatcctggctcaggatgaacgctggcggcgtgcttaacacatgcaagtcgaacgaagcactttaattgatttcttcggaatgaagtttttgtgactgagtggcggacgggtgagtaacgcgtgggtaacctgcctcatacagggggataacagttggaaacgactgctaataccgcataagcgcacaggattgcatgatccggtgtgaaaaactccggtggtatgagatggacccgcgtctgattagccagttggcggggtaacggcccaccaaagcgacgatcagtagccgacctgagagggtgaccggccacattgggactgagacacggcccaaactcctacgggaggcagcagtggggaatattgcacaatgggggaaaccctgatgcagcgacgccgcgtgagcgaagaagtatttcggtatgtaaagctctatcagcagggaagaagaatgacggtacctgactaagaagcaccggctaaatacgtgccagcagccgcggtaatacgtatggtgcaagcgttatccggatttactgggtgtaaagggagcgcaggcggtacggcaagtctgatgtgaaatcccggggctcaaccccggtactgcattggaaactgtcggactagagtgtcggaggggtaagtggaattcctagtgtagcggtgaaatgcgtagatattaggaggaacaccagtggcgaaggcggcttactggacgattactgacgctgaggctcgaaagcgtggggagcaaacaggattagataccctggtagtccacgccgtaaacgatgaatactaggtgtcggggagcattgctcttcggtgccgcagcaaacgcaataagtattccacctggggagtacgttcgcaagaatgaaactcaaaggaattgacggggacccgcacaagcggtggagcatgtggtttaattcgaagcaacgcgaagaaccttaccaagtcttgacatcccactgacaaagtatgtaatgtactttctcttcggagcagtggtgacaggtggtgcatggttgtcgtcagctcgtgtcgtgagatgttgggttaagtcccgcaacgagcgcaacccctattcttagtagccagcggttcggccgggcactctagggagactgccagggataacctggaggaaggtggggatgacgtcaaatcatcatgccccttatgacttgggctacacacgtgctacaatggcgtaaacaaagggaagcaatcccgcgagggggagcaaatctcaaaaataacgtctcagttcggactgtagtctgcaactcgactacacgaagctggaatcgctagtaatcgcgaatcagaatgtcgcggtgaatacgttcccgggtcttgtacacaccgcccgtcacaccatgggagttggtaatgcccgaagtcagtgacccaaccgcaaggagggagctgccgaaggcaggactgataactggggtgaagtcgtaacaaggtagccgtatcggaaggtgcggctggatcacctcctttctaaggaaatcaagtagagagtttgttcactgtttagttatcaatgagtatctgcctggatgagcggagacaacggtgcaaattcatttgcaagccggtgttgaagcgaagacagattggacgaatgactctagcaagatgaagcggagcggaatcgagcgagtcatgagtacaaaggagcagatacgaatgacaactttatatttctggtggcgatgcgcttaggggaaacacccgtccacatcccgaacacgatggttaagacctaagcggccgatgatactatactggcgacggtatgggaaagcaggtggctgccagattaaatagcaaacataagatgtttgcattagaagaaatcaaagatttcttcgcagatatcttattacatatagaacgggcatcaagagtcagacgacctggtgctaacctattccaacagggtagtgttgttctgataaaactggttttaccagtgattagagatttcaatacgttgaggtttctaatgactgataaacattcagtcagacagtaacaaaagcattgaaaaatgccgatgttgcggaaattgcgaagcaatttctaatgcgaacgaagttcgctattgtaccttgaaaacttcatacagaagattttgatgaaaaagattttttatcaagacatccgagaatatcgtaaacaaagtttacgaccaaaccaaacgaacgaaagttcaagatcgaagcaattcgatccgcgttattaaacgcaaagacccagtttctaacgctatagaaactgtaaacgaggtcaagcaaaaaagagcgcagggtggatgccttggcactaagagccgatgaaagacgtgataagctgcgaaaagctacggggaggagcaaatatcctttgatccgtagatgtctgaatggggaaacccacatgagcatacctcatgtatccatacgccaatccataacgtatggaggggaacccggtgaactgaaacatctaagtagccggaggaagagaaagaaacatcgatttccaaagtagcggcgagcgaaatggaaagaggccaaaccggaatgcgtgcattccggggttcggaccgcataattgattcattgatcctagcagaaaggttttgggaaagcctgccagagagggtgaaagccccgtaagcgaaaggaaagatgacatggcggaatccagagtacatcgagacacgagaaaccttgatggaatgagcggggaccaccccgtaagcctaaatactccttagtgaccgatagcgcatagtactgtgaaggaaaggtgaaaaggaccccgggaggggagtgaaagagaacctgaaaccctgtgtttacaagctgtggaagtgctttatatgcacaaccgcgtactttttgtagaacggtccggcgagttacgggtaccggcaaggttaagcacttaaggtgtggagccgaagggaaaccaagtctgaatagggcgtcaagtcagtatccgtagacccgaaaccgggtgatctacccatgtccaggttgaagttgccgtaaaaggcaatggaggaccgaacgcacatccgttgaaaagggtggcgatgaggtgtgggtaggggagaaattccaatcgaacccggagatagctggttctcctcgaaatagctttagggctagcctcattttagtcttatggaggtagagcactgaatttccgcgggggcgtcaaagcttaccaaagaatatcaaactccgaatgccatgtagatgatgaatgggagtcagactgcacgagataagttgggcagtcaaaagggaaagagcccagaccaccagctaaggtcccaaagtgtgtgttaagtggaaaaggatgtgggatttcaaagacaactaggatgttggctcagaagcagccacacattcaaagagtgcgtaacagctcactagtcgagaggtcctgcgccgaaaatgtccggggctaaaacacaacaccgaagctgtggaatcacgtaagtgattggtagaggagcattcttaagaccgacgaagctgtaccggaaggagcagtggagggataagaagagagaatgccggaatgagtagcgagagagaggtgagaatcctctcggccgaatatccaaggtttccagagtaaagctgatctgatctgggtaagtcggggcctaaggagaggtcgaaagacgtatccgatggacaacaggtttagattcctgtaccacatatgaacagaactgtggggacgcatgtggagagcacgagccgggaatggaaataccggtacaagcggagaaggagtctggttggcaaatccgccaggcaatccgaagacgtgatgtggagcgaattaaagtagcgaagcgtgtgagccatgtgccgagaaaagccgctattgtttcatgtgtgcccgtaccgtaaaccgacacaggtggatgaggagagaatcctaaggccggcggaagaagcattgttaaggaactcggcaaaatgaccccgtaacttcgggagaaggggtgcctgctaacgcaggccgcagagaataggctcaagcaactgtttagcaaaaacacaggtctatgcgaaaccgaaaggtgaagtatatgggctgacgcctgcccggtgctggaaggttaagaggagaggttagcgtaagcgaagctttgaatttaagccccagtaaacggcggccgtaactataacggtcctaaggtagcgaaattccttgtcgggtaagttccgacccgcacgaaaggcgtaatgatttgagcactgtctcgacaatgcatccggtgaaattgaagtaccagtgaagatgctggttacccgcgccaggacggaaagaccccatggagctttactccagtttggtactgggattcggtactgcatgtacaggataggtgggagactaagaacttgggacgccagtttcaagggagtcgctgttgggataccacccttgcagtattggatttctaaccagccgccgtgatccggcggtgggacaatgccaggcggggagtttgactggggcggtcgcctccgaaagggtatcggaggcgctcaaaggttccctcagaatggttggaaaccatttgaagagtgcaaaggcagaagggagcttgactgcgacaccgacgggtggagcaggtaggaaactaggacttagtgatccggtggcataaagtgggattgccatcgctcaacggataaaagctaccctggggataacaggcttatcactcccaagagttcacatcgacggagtggtttggcacctcgatgtcggctcatcgcatcctggggctgtagcaggtcccaagggttgggctgttcgcccattaaagcggtacgcgagctgggttcagaacgtcgtgagacagttcggtccctatccggcgcgggcggaggatatttgagaggagctgtccttagtacgagaggaccgggatggacggaccactggtgtatctgctgtcgaccaacggcatggcagagtagccaagtccggaagggataaacgctgaaggcatctaagcgtgaagcccccctcaagatgagatatccctcacataagtgagtaagatcccttgaagactacaaggtagatagggcagaggtggaagcacggtaacgtgtggagctgactgttactaatcgatcgagggcttgaccaaaaagtttgttggatgatttctgtatgaagttttgaaggtacaatttttatggcccaatggctcagttggttagagcgccgccctgtcacggcggaggtcgcgggttcgagtcccgcttgggtcgtttttatatgggatcttagctcagctgggagagcatctgccttacaagcagagggtcataggttcgagccctataggtcccatttcttattatatatgccgatgtggctcaattggcagagcagctgatttgtaatcagcaggttatcggttcgagtccgatcatcggcttttcacataatttcatattgtgtgtaaatgggcagattcccgagtggccaaaggggacagactgtaaatctgctgcaaattgcttcggtggttcgaatccacctctgcccattcttttgataacaaatattatcagaagtaatttcatagcgcgggatggagcagtctggaagctcgtcgggctcataacccgaaggtcataggttcaaatcctattcccgcaactcaatgcgaaagcatttgtgcccagttagctcagttggtagagcagaggactgaaaatcctcgtgtctctggttcgattccggaactgggcattgtgttttgtttaaaaataatatgggatactagctcagttggtagagcacctgacttttaatcaggttgtcgggggttcgaatcccccgtgtctcattaggaaatgaagagcggaaagccggtaaattcaaggcttcccgctctttttatgccattttcccagtagggaaaagtaagcaaaagttgatgatttttaatgtccgcagcgcgtccgcaaggggtattttgacaccaatgtccgcagtgcgtctgcaaattaaaccgccagaatatcattcacgaccgccgcggcatcttctttctcgtccatgatgtggttgtagacgtccagcaccatcttttcggtgtcacccatcagctgggcgatttttttaatgctgatcgcaggtacctgatagcagaggtttgagcagtagttgtgccggaagatatgggcggtcagatcagatatgactgggaacgcaccggtaccaccggcggcatggttcatttttctcacgatcaactgccacatcttgacatacgctgaatgtgtcatgatggacccatcacggcaggtaaaaaggtatgagccgggcagagcagccaaatactcttttaggtatgcggcggtggctgccatgtcgattgtgaaccggatctgcatgttcgtcttctcggtcggacttggaatcggtcagggattccagccggtgtcggcattcaactatggcgcaaaaaaatacggaagggtccggaagggcttctatttcacactcacagcgggagaagtgctgctcggcgcgattgcggtcatcgggatgtttttcccggcacagcttgtggcggtatttcagaaagatcccgaggtggtggcgatcggagagggggcgctccgggtccagcttgtggcgctgttctttcagccgatgacggtctgcgcgaacatgatgtttcagagcatctggaaaaacggcagggcgatgttgcttgccatgttgcggaatcttatgtattatagtgaaaaaaggttgacagtcccggcataaagctgtatcatacttaagtggattcacactgcaacgcgttgcagtgtgaaaatataagaagataccatatgcagcagtgcgtatgacagaaaggatcaatagatatggaaatggagatggaatttttgcggaagctgcctactccgcaggagttaaaggagcagcatccggtcagtgcacagattgtagctaccaagacgaagagggatgacgagatcaggaatatttttgaaggaaaatcggacaagctgattcttgtgattggcccatgctcagcagataatgaggatgctgtgatcgactatatttcaagactccgcacggtgcaggagaaggtggcggataagatttttatgattccgcgcatttataccaacaagccgcgcacgaccggaatcggttacaagggcatgctgcatcagccggatccggagcgggaatcagatatgctaaaagggatcattgcgattcgtcacatgcatatgcgggcggtggaagagaccggctttacctgtgcggacgagatgctctacccggagaatcaccgctatctttcggatctgctgtcgtatgtggcgattggagcacgctcggtagagaaccagcagcacagactgacggcaagcggcgtgggaattccggcaggaatgaagaatccgaccggcggagatatttccgttatgatgaactcgatcattgcggcacagcacggacatacgtttttataccgtggctgggaggtcaagacgaccggcaatccgtatgcacatgccattttgcgcggatatgtggacaagtttggcagaaatattccgaattatcattatgaggatctgcagaatctgctggagcattatgaagaggcgaaggaagccggacacgagctggcacatccggcggtcatcatagacacgaaccactccaattccagcaagcagtttatggagcagatccgcatcagcaaggatgtcctgcacagctgtaaggtgtcaggagagataagaaagctggtgaagggactgatgatcgagagttatatagaagacggagcacagaaggtcggtgacggctgttacggaaagtcgatcacggatccgtgcctgggctgggagaagaccgagaagctgatctacgaattggcggaactgtggtaaaggagagagaatgtaccggatattgatcgtggaggacgatgagatcattgcgcgaagcttaaaaaagcatctggaaagctgggattatgatgtggtctgcgtggaggatttttccgatattatgaaggagttcgcgggggcggcgccccagctggtgctgatggacatcaagcttcccttttacaacgggtaccactggtgcagcaggatcagggagatgtcgaaggttccggtaatcttcgtgtcgtcggcgtcggataatatgaatatcgtcatggcggtcaatatgggcggcgatgatttcattgccaagccgttcgatctggatgtgctgaccgcgaagattcaggcgcttctgcgccgcacctatgattttgccgggcagaatacggtgctggagcatagaggcgcactcttaaatctgggcgatgcgacactcacctgcggggagacgcgggtggacttaacgaaaaacgaacttaagatactgcaggtgctgatggagaacaaggagaagatcgtgtcccgcgatacgttgatgacgaagctgtgggaaagcgacagctttgtggatgagaacaccctttccgtcaacgtgggaagactgcggaaaaagctggatgcagcaggacttccggattttattttgacgaagaaaggaatcgggtaccatatcgggtaggggattttgatgaagcagaaaataggaagatcctacataaaatgccgtctgaaatggattgccgcagtgactggctgcgggatcgtgatgacggcagtcttatttttaaatgaagtgcctgccggggagattgcctacggcatgctgttgtgtctgggaattctgctgcttgcagtgacgatggataggataagttacggcagacggcacagggaactgctggcattgcggcagtcaataacggtatcgctggagaatcttccggaacccggcgaaatcctggaggaggattatcaacggctgcttgggcttttggcggaggagaaaatgcgtatctggaatacggcagtcagcgaaaagcgcgatctgatggaatactataccatgtgggtgcaccagatcaagacgccgattgcggcgctaaagcttttaatcgaggaggaagcggatattcccggtgcagaggagcctttgggagcggacagggaaaggctgcagcggcagagggagaagcgcaaggatgaagaactacagcagctgtttgcgattgagcagtatgtgaacatggcgctttcgtatatgcgtctcggatcggagaccacggactttgtgctgcggcagacagatctcgacgaagtgatccggatggcggtgcgccgctatgcgagacatttcatcagcaagaagatcgtactgcactacgaggagacgggggcacgggtgctcaccgatgaaaaatggctcggctttgtcatcgaacagctgttgtcgaatgcgctcaagtacacgcatgaggggagcattacgattgggatggaggagggacgccttaccattaccgatacggggatcggaatacgcgcggaggatctgccgagagtctgcgaaaaaggctataccggatataacggtcatgccaaccagaaatcgaccggaatcgggctgtatctttgcagcacaattttaaaaaagctggggcacagctttacgatcacatcgcaggaaggaacgggaacccgggtgatgatcggcttcccggaagagtcatagaagaatcttacaaaaacgtaagaaacagcagagaaatgtaatccaaagaaatggcttgcatttctctgttttgttatactgggtacagtcaaggaaaggagagagacacatggctattctggaagttcataatttgaaaaaaatatatacaacaaggtttgggggaaatcaggtgcaggcgcttgcagatctgaatttttccgtggaaaaaggggagtatgtcgcaattatgggagagtccggttcagaaaagacgacactgcttaatattctggcggcgttagacaaaccgaccgcgggggaagtgctgttgaataataagaacattgtgacactcggcgagagggagatttccaaattcagaagggagaacctgggctttgtttttcaagattttaatttgctggatcatttttcattaaaagataacattcttctgccacttgtcctggcagatgcaccggtgcaggagatggaggagcggctttggccgattgccgaaaagcttgggatcgatgtgctgcttgagaaatatccttatgaggtttccggcggacagaagcagagggcggcggttgcccgcgcactgatcacccgtccgcagctgattctggcagatgaaccgacgggggcgctggattccagggcgaccgacggactgttgaagctgtttggcacgatcaacggggaaggacagacgattcttatggtgacacattccacgaaagcggcgagccatgccaaccggattctttttatcaaggacggcgaagtatttcatcagctgtaccgcgggaatatgacgaatgaggagctgtatgtgcggatttcggatacgctgacggttcttaccaccggcaaagagggaggctgtcatgcgtaagttatatgtcaaactggcagcagtcaatatccgcaataacagacagctttacctgccgtaccttctggcgggggtgttctcggcagcgatgttctatctggtaatgtccattcaggataacccggggctggagcagatgagaggcggcgcctatgtggcggtaacgctgctgctcggagtgatcattgtcggactgttcgcggcgattttcctgttttataccaacagcttcatcatgaagcggcgcaagcgggaattgagcgtatacaatatacttgggatggagaagaaacatatcgccagggtgctttttctggaaatgctgtttacggcggcggttacgatcggcggaggcctgttgttcggcattgcattcggcaagctgatgacgatgcttttgtaccgcatgacaggattcaaccagagcgttccgtttaccatttcgctgacgggatgccgccacacgctggtgcttttcggctgtatatacgcggtcacacttttctataactttatgcagataaagctttccaatccgatggaactgctgcacagcgccaatgcgggagagcgggagccgaagacgaaagtgctgctggcggtgatcggagcggcggcactcggcggcggctattatctggcgcttacggtggcggacgcagtctctgccattaccatgttttttgtggcggtgctgcttgtgattctgggaacgtattgtctgtttactgcgggcagtattgccgtactcaaactgtttcggaaaaataaaaactattattacaaatcaagacattttacgacggtttccggtatgatctaccggatgaaacagaacgcggtgggacttgccaatatctgtattctgtcgacgatggttctggtgacggtttctaccaccctgtgtatgtatctgggagtggaagacgccctaaaacggcgttttgcacatgaggtgtctgtggtgtcctactataatgcaatgccggaacatccggaggaagtggatgccctggcggaagcatccctgaaggattccggacgggtactgacggggcacagcgccatgttgaacatgtcgctgaccgcggtgcgcacggacgatggattttccgtgaccggcatcggggcaggcacagattacagtattagtgatgtggtgctgctcacgattctgccaaaatccgattgggagaattacaccggtgaaacggtcggggaacttggctgcggagagattgcactggcagcatcctctgcctatgaaaaagggacgttggcgcttgacaacgagacatatcaggtaaaacagatctacgcatatcctgagacggatcacgattatctggatgacatggcagacgacagtgtatttatgattgtgccggatagggaggcgctggggcagatttttacggagttgaaacagaactgggacgaggagcgtgtaagcctgcagatcaaatacaatatggcgtttgacatagacggaacagcagaagaaaaagtggcagcggaaaatacgcttcatgcggcgattaccgcatacaatgacgggcatccgtcggatgatgcaaaggactcttattctagaacgtatgtcgaatgccgggcacagaaccgggatgaatactacagcttaaacggtggtctgctttttatcggtctgtttctgggcgcgatgttcctcatggtgacggtgctgatcattttttacaagcagatctcggaaggctacgaggacaaggaacggtatgccatcatggagaaggtcggcatgagcaatgccgaggtaaagcggagtatccgtacacagatcctgacggtatttttcctgccgatcggggcagcagtacttcatgttgtcatggcattcccgatgatcaaatggattctggcggcgttcagcctcaacaataccgcactgtttgccttatgcgttgcggttacggcattggtgtttctgctgatttatctgctggtgtttgcgctgacttcccgcagctactataagattgtggggaatcaggtttagggaaaatggttcccaccataaaatccaaaaactcttccagtgtcattttagggttctgcagccagcgaatgacactggcgagaaggccggacaggtaaaaatcggcaagaagtgccatctcgtaatcgtcatgtccctccgagggaacaaaataacggtttaagaggggccataccacttctttcaggcgggtcgcaaaatgcgggtcgccatgatcgcttaagagtacagcagcataggtttcatatgtctgcatcagatctaaaagaattcccatctgaccggaaaggtcaaaggtatcatttttttccagagaatcattcagaacatctgtaattttcccgaggatttcttcctcaatctgatgaagaagatcatatacatcattatagtagagataaaaggtgccgcggttgtaaccggcaagctcggtaatctccttgatggagattttttctatcggtttttgcgcgtagagagaccagaaagcgatccgcagattatttttggtctgttctgtgatatggggctgctttttcatgaaaacctcccggtataagatttgtgttcattttgtcttcacgtaaattatagcacgacaacgtgttgtcttcaattttttaacacgtgcggagaatctgttgattgatgaaaggcagcgcggggagtacattaggcatagaaaatggaatctgcatagagataaaaaacagagtctgggaagaaaggcggccttttatggcatatatcgaatttaataatgtaacgaaggaatataagacaggtgagacttcgatcaaagcgctggatggagcctcattttctgtggagaagggcgaactggcagtgattctcggttcctccggtgcagggaagacgacggcgctcaatattttaggcggaatggatgtgccgactgcgggcgagatcaaggtggatggcagagatattgcaaagtataacaaaaagcagctcgtcggataccggcgtaccgatatcgggtttgtattccagttctacaatctggtgccgaatctcacagcgatagagaatgtggaacttgcggcgcaggtgtgcagaaattcgctcgatgccggggagatgctcacaaaagtgggactggcggaccgcaaaaataactttccggcgcagctttccggaggagaacagcagcgggtgtctatcgcgcgtgcgatcgccaagaatccgaaactcctgctctgcgatgagccgacgggagcgcttgactataacaccggaaaacagattctgcagctgctgcaggatacctgccggaacgatgggattacggtacttctgattacgcacaactctgcgctggcaccgatggctgaccgcctgatccgctttaagagcggaaaggtgacagagattacctgcaatgcgcaccctacgccgatcgcggagatcgagtggtagcggggcagaagagaaaggcagggatactgatgaagagtgcatataataaggagatatggcgggcgatccgcaaggggaaaaaacggtttttctccatcatgctgatcacgattctgggtgtcggaatgctcaccggattgcgggctgcctgcatggatctgcgctattcggcagatcagttttatgacagacagggactgtacgatatcagtgtcgtctcgacgctcggacttacggagaaggatgtggatgcgttaaaggcactggacggtgtcgcggatgcggtcggcgtctacagtgagacggtacatgcgaaagtaaacgatcatgaggtcagcattgcagtctgcacgttgaatgacaggggaatcaatcagccgtatgtgttgtccggcaggctgccggagagtgcggatgagaccgccgttacaaccgcgtttgccgatgagacgggatgcggcatcggggatgtcatcgcggtggatacaacagatgatgaggagtcttcgctgctctgcagccgctttaccgtaacgggaattgtggtggatgtgcaggatgtcaacaatgcaaagggagcgacggcgttccgctccgggcagtcggaggatgacactgtgttcatcttgccggaggcggcagacagcgatatttacacacaagtctgccttaccgtcgatggtgctgcagaattgttctgctattccgatgcctatgaggaaaaggtcgcacaggtgacggatgcgattgaaacgcagattaaggaaaatcgggagcaggcacggtacgtggaagtcacggatgaggcgaaagagaagcttgcggatgcgaaagcggaggcggaagagtcctttgctgaggcagagcagcagctttccgatgcgagagcagagctggataagggctggcaggaactttccgacggccaggaggaatttgatgcggaaaaacagcaggcggaggatggttttgcggaagcgagagatgaaattgccgcgggaaagcagcagattgccgatggcagcgcgcagctggatgcagcggagcagcagctttcggaaggcgaggcgcaggtggcatccggtaagcagacgctttcggcaaaggaagaggaaacctatgcacagttagacgcggcacgcgcacagcttacagagagcagtaaacaggcagcggagacggaggcggcattggaagcgcaggcgcaggaggtcatccaggcgtacggggaagcatggcccgctgaggcctgggacgcctatgtgcaggcggcagtggaggcgtatttacccgtagcaagagcggtggtcgcagagcaggatgcctcgcaggcacaggcggcggtgccgggactggtggcggacagccagagtgcgtttttggaggcgctgcagcaacccacagccgatcagctggtacagcttgcaatgggactgggaaatgtgcgggcgacaatccaggcgctcggcgaggcacaggcgcagctggatacggcagaacagacggcacggcagcagtttgatgcggcatggaacgaactgaacgaaggggaagcacagatcatcttcggaaaatcgcagattgccgataagagagcagagctggagaacggcagtatggcgctttccgaaggcgaggcgcagctggcgcaaaaggaacaggagactgcggcgcagataaaggacggtgaggaaaatctcgccgaaggacgggaaaagctgcttgaaggtgagacggaatacgcggacggcaaggcagaatatgaagaaaatcttgcggacttcaatgagacgattgcggaggaagagcaaaagattgcggacattgacatgacacagtggtatgtacaggatcgcacgtctctgagcggttatgccaatgtgaagagcgatgcggcgtcgattgaggcgatcggtacggtgttcccgatggtatttttcgttgttgccattctcatcagcctgacgacgataacccgtatggtggaggaggaccgcggtctgattggaacctacaaagcgctcggctttacggatcgtgagatccgcagaaaatatctggtgtatgcatgtgcggcgagtgtgtccggcggaattctgggaaatgtgtgcggatttgttcttctgccggagattattttccggatttttgatacgatgtatctgttcccggaatatctgctgcgctttatgccgctgctcggatgtggcggagctgcactttttgcggccggaattgtcatcgctaccgcctgtgcatgtaaagcggaacttgtacacatgccggcagttctgatgcggccgaaagcgccgcgcgcaggctcccgcgtactgctggagcgcatcacgccggtatggaagcgcctgtcatttctcaataaagtgaccgcccgcaacctgttccgctataaaaagcgtcttttcatgaccgtagcgggaattatgggatgcatggcgctcttacttttcggattcgcggtgagggattcggtgacagacctgctgccgcgccagtatgagaatgtgtaccggtatgatgtcatggcggcgggggcagcatccgacaatgacaagattctttcctatgtaaatggggatccgaatgtgcaaagtgcgctgaacgtgcagatttccacggtgaagctgaagaatgctgccgggaaggaagaaaaggcacagatgattgtcgtgccgggggatgagcctcttgcagagtacattggtctgtacaatcttaaggatgaggagatcggccttttggacggcgagattctggtgacgcagaatgcggcaaatgtgcttgggtttgcggccggcgatcaggtggagattcaggatcaggatctgaatcagcgggaagtgacggtaagcggtctcgtccgcaattacctcggcaataacgtctatatgacagagaaaacctatgaatcgctgtttggcgattatgaaccgaacggagtatttttaaagttgtcggaagaatgttcggatgaaattgcctatgcagatgatctcggcggaaaagagggtatcgtgtcctacaccagcaagcaggagctttcggatgagttctcggatgcgttcaccctgatcaatatggtggtctacattgtgattatcatggcggcggcgctcgcgttcgtggttttatttacgctgtctacgacgaatatttccgagcggagcagagagctggcgacgattaaggtgctgggattttttgaccgtgaagtgcatctgtatgtcaacaaagagaccatgatactcacggcgatcggcattgtctgcggaattccgctgggatatgcgtttgcgcagaccttaacgtatgttttgaacatgccgtcgatttatctggcggtgtcccttcacgggaaaagctatgccatggcggcaggcctctcatttttgtttgcgatcctggtggatctgctgacgaaccgctccctggatgaaattgatccggtggaagctttaaagagtgtagaatagaaaaagcgccggcaccgatgggtgaagttcatcggtgccggcgcttttgggatgtgttacatcctgtgttttatgatgcggatgtcagaatctgcatcgtttatcctgtgggtaattaacatccgaggttaaagtatttgcaaagagcagtaaataactcggaacagctattgaagttaaagcacatagtttcgtcctccttattcttatttgtgttagctaagcacaaaagaattgtaacaattatgtaacaattctgcaataggaggatattggaaataggattacgcttcaagctctattatgatatgcgaaaagtgcggcggggggtctgaccaccaaagacaaaataaaagcccggtaaaatccataatggattttaccgggctttttggaataagcagacaacgggaatcgaacccgcctcctcagcttgggaagctgatatactaccgatgtactatgtctgcaaaacacatactattattatagcgtaaataaaaaagattgcaaccactttctgtgagagatcagtgttgaagtggagatgaatatgatataatgaactctgacgagttcatattagaagttcctgcggaacttcggatgcgcagaagtcggcgcagaaaagaggatataatgttcgcgaaggcaaaagtgggcatgaaacaaagacgtggatgatagggcgaatacccgtcagtacgggaaatctttgatttcccgtaccggcactgcgatacaggaagagggaaatccaatgaaaacagttgcaatcgtggcgtgttccaacgggcagaaagaagaatatcgaagccagaacgaggaactggcacggtatctggaggaaacgggacacaaggttttatggagcaatgatatctatgaaaaaaatgccgcattttcaggtacgggagcagagcgcgccgcggaactgatgcgtttcttcaatgacccggaggtggaggagatctatgacatttccggaggagatctcgctaatcaggtgctggacgggctggactatgccgccatccgaagaagcagggcggttttctggggctacagcgatctgacgacggtcatcaacgccatctatgcacagaccgggaaaagcagcgtgctctatcaggtcaagaacatggtctggggagagggaaaagaggtgcagcggcggagatttgagaaccgtgcggcgctgtttgacccgcaggttcgctttgtgcagggggagaagatggaaggcgttgttgtcggcgggaatatccgctgctttttgaagctgtcgggaacccgctattttccggatctttgcgacaagattctgctgctggaagcatacggcggcgaagtgccgcagatggcgacgtatctggcgcagctaaagcagctgggggcgtttgagaaggtcggaggaattttgctcggaacatttacggcgatggaggcgcatgcgtgcagcccggatatcactgcattggtgagggaggcggcagggacgcagattccgatcgcaaagacacaggaaatcggtcacggaaatgacgcgaaagcgatccggatcggagaaaggatatactgcggcggagacgaagaatgtcgaagcgttgttacagatgctgaaaggagacagttggaaaccagatgaaaaaagagatgacatacacagaactagcgaaagagacggcaatcctgacggctgccgtggcgattatcgccacagccgtatacttttttctggtgccgagccacgcatccgtcagcagcatttccggtcttggaatcgtgctgtccaattttataccgctgccgttgtccgcgatcacgatgatcttaaatgttgtgcttttaattatcggattttttacctgcggaagggaatttggcgtgaagacggtttacaccagtgtggcgctgccggtgtttctgggaatttttgagagaatcttcccggattacgaatcgctcaccggcagccaggaactggatgtgctgtgctatattctggtggtcagtgtgggactcagcattctgtttaaccggaatgcgtcttccggcggactggacattgtggcaaagatcatgaacaaatatctgcatatggagctgggaaaagccatgtcgctgtccggcatgtgtgtggcgctttcggcggcactcgtctatgacaagaagacggttgtgctcagtatcctcggtacatatttcaacggtattgtgctggatcattttatttttgaccatgacatgaagcgccgtgtctgcatcatcaccgaaaaggaagaagaactgcgcaagtttatcatagaggatctgcacagtggagcgacgatctatgagtcgatcggtgcatacaatatgcagaagcggaacgaaatcatcgccatcgtggacaaggcggagtatcagaaactcatgaattatatcagtcgtgaggacccacatgcattcattacggtatacacggtgtcagatatccgctatcagccgaagcggcagcaatgaagaatgcgatacaactgttgtaaaagggagaaacatacatggaaatctatgataacgcagacagttcatacaaaactgccggggcggaaacctactatctgccggttctttatacggaggacgagcgcagcagctacgccgcatggggcatcaaaaaagaaaaacagttgatgccgtttgccattgtgacgatcatcattgacgcgtttgtgctctgtgccacggtcgtttatctgtttgcggtacagcggcagacgccggcattttccgtctggctttcctgttggggcggtgtggtcggcgatgtctcctacggtatggcgctggtcttgacggttcttattttaaagccgcttgactggctgtttgataaaatcatgcacagaccggagcaaccaaagatgttacaggtgacgccgaaggaaacgggcgtctcgtatctcattcttcgcggtacaacggtacttgcgcaaggactgctcccgtggaatgcgtgggaggctgcgctcactgtggagacgaatgagatattgctcgaggggcagagactgcggatcggaagcaatacgatcgcatcgatctatccgcctgagaaacagaagccgtggatggatcatccggcggagcagataacgggaaccatcagcctggcgcatatccggaaaaatatgcaggggtaccgggcgtccctggaagaacagaaaagggaagcagagtggagacggcagaatccatagatctgccggtggaaaataaaagaaaatggagacagacacagatgagatatccgaaaaatttatccgaacatggaacgatcggttttgtggcgccatccttcgggtgtgcgactgagccgtatcacaccgcatttttgaacgcacagaaaaaattccgggaaatgggacatcccctggatctcggaccgaattgttatgccgactgcggaatcgggatcagcaacacgccggaggcgtgcggcagagaactgacagagtattattgcagcgataagaatgaggtgctgatctcctgcggtggcggggaactgatgtgtgagacactggacgcggtggattttgaacagatccgggcagcggtaccgaagtggtacatgggatattccgacaatacaaacatgacatatcttttagcgacgctctgtgataccgcatcgatctacggcccgtgtgcggcagcgttcggcatggagccgtggcatccgagtctttcggatgcatatgcacttctgcgcggacagaagcatacggtaaacggatatgatctctgggaaaaggaaagcttaaaagatgccgagcatccgcttgtgccataccatgtcacggaacagcgaattttgcatgttttcccggaaccgacggaggcacttacggtgcagggacgcctgatcggcggatgtgtggactgtctggtgaatcttctggggacaacttatgataaaacaaccgggtttgtggaaaagtataagaatgacggtatgatctggttcctggaatcctgtgatcttaatgtgatggcgatccggcgggcggtctggcagatgaagcatgccggctggttttcccatgtgaaagcttttctgatcggaagacctgccgtctacgggcaggaactgatggggctggaccagtaccatgcggtgtgggatctgttgaaagattacggggtgccggtcgttatggatgtggatatcggacaccttgcaccgatgatgccgctggtgtgcggaagctatgcaacggtgcaggtgaacggaaatgacatctccgtgaagatggaatatttatagaataatgttaatatttttgccgatgccggtgtttaagagggtatccagatccagactctgggatacgatctgtgccgcggtggtgacagtgccatcatccagtttctctgtggtgccggatgaagtggtgccgtctgctgcggaagaacctgtggcagcggcattttttttctgcatcagcaggttgttatcagaggtaacgagcgcctcaccgcggtttgcaaaccgtttggcatacgttgaagtgcgctgcatgtaagtcgcgtcagcggaaaacagttctttgaacttggagagatctgcgctttcaaacagggtggtacggcttgtgagcgtgccgtcatcattgacggtgatgccgatcttgtcaagttcggaagaatattcgcttgtaatatttttcaactgctttgcattgcgctctaaggtacggtccgaggaactgccggcagaggaaagcatgttgttgtaggtctggatataggcgagcacgctgttgcgcgtattggtgccctggtcgtccgaaaaatcagaggatgtcagccggcgcactgccttgcggagcgccctgccgtcggcgagagcgagctggttgccgctgaattcacggcgtttggaggaagtgccggcttcccggtcggaacggtagaaactgcgcaggtaatatttggaacttaaggtggtgccggatccgatatacgctgtatttgacatagtgattcctccttaaaaagattctctaatatgtttcggcagaatgcggcatagaattaaccatagaaaacaaaaaacggatatgctatactaaattccaaagaattcgcctgaaagcaggaaatacgaattctggtaaatgggatgtgtgagaggaggatatcatatggaagcaatgatctggataggtctgataattctttttgtgttggttgagattgcgacggtaggactgacgtccatctggttcgcagggggcgcgctgatttccctgattctgtgcctgtgcggcgtgggactgggctggcagatcggcgtatttttcgtggtctccctggttctggtggcatttacccggccgtgggcgatgaagtatttaaagccgcacctgatccggaccaactacgagcaggcgatcggtgaaaacgtgtgtctgacggagacggtggataatcagagaggaaccggcactgcggtctacaagggacaggagtggacggcaagagccagcgaggatggaaaaagatatgaggcgggaacgatcgtgaaggtaaaggagatccgcggtgtgaccatgtatgtcacggaaagcggactgatgccgcaggttccgacaccgccgcagacagagcaagaggcagaataatatgaagcttggaatggtatttgagggaggcgccaaccgtacggtgttctcctgtggagtgatggatgcgtttctggaggaggggttgatgccggattatctgatcggcgtctccgccgggattgcgtacggtgtatcctacctgtcggggcagaagggcagaaatatagaggtagtggaaaattatattgcggacaagcggtatatgggcatgcggcatctttttaaccggaacgaaaaagcgtattttaatacgaagttcgtgtttgaggaagtgccgaatgaactgattccgtttgactatgacgcgtttgcggcgtatccgggaaaagtcgaagcggcagtgaccaacattcataccggaaaagccgaatatgtcgaagtgccgaggggacgggatatgcgcgatacgctggtggcgagctgttcgctgccgatccttttccagccggtgaagcttggcagacattattatctggacggcgggattgccgattccatcccgtatgaacacgcattggcggagggatgcgacagactcatcgtggtgcttacaagagaacgcggatatgtgaagaagacggagaaagcagtccgccttacggataagctgtacaagaaatatccgaagattgtggagagcatggattcccgggcggagcgctacaatgaatgtatgaccagactgcaggaactcgagcaggagggaaaaatcctcgtcatcgctccggaatccacttatggggtgggacggacaaccacggacgtcatcaagctccggagactttacgacgagggttatgaactgacagaaagaagcatgcaaaaactgcgtgcatatctgggataagaaagagagaaaacaaacgatgaagattgtatttttggatgcaaagacaattggtgacgacattgatctgtccggttatgatgctcttggtgaagttgtaaaatacggattttccacacccgaggaggcaagagagcgcacccgggatgcggatgtgattgttctcaacaaagttgtgatcaacgagcagtccatcggcgaggcggagcacttaaagctggtatgtgtgacggcgacgggaaccaacaatctcgacaaggaatatctggatcagcgcgggattgcatggcgcaacgtggcgggctattccacggagacagtggcacagcatacgtttgcgttattgttctatttgcttgaaaagttacattattatgatgagtatgtaaaatcagaaaaatatgtgggagatgtttcctttacacattttgacaatgtgtttcatgagctgagcggaaagacatggggcgtcatcggcctgggcgcgatcggcagaagagtggcggacattgcgggtatgttcgggtgccgggtgctctactattccacctccggaaagcacgatcagccgggatacgagagagtggattttgacacgctgctcgcggagtcggacatcgtgtcggtgcatgcgccgctggatgccaacacggaagggcttatgaacgccggggcgtttgcaaaaatgaaaaaatctgcgattttcctgaaccttggaagaggaccgatcgtggtggagaaagatctggcggaggcgttaaagaacggtacaatcgctgcagcggggctggatgtgctctcggcggagccgatgcgggcagacaatccgctgcgtgagatcaaggacagtgataagctgatgattacgccgcatatcgcatgggcaagcattgaggcacgcgcgcgtctgatgaagatcattgagggacagatccgggaatttttccatctgtaaaagaatgcgcctatttgggggcgcatcagcttggaatctgcgcatccagaccgctgtggaaggacagattgccgtattcttttagaaattccagagtgagctgtttctgcagctcactttttggttctgtatgcagtaatgtgtgaagctttcgcatcatggtaaggcagcgcgcactgcttttttcgtacagatcaaaaaagctttctgtggagacgcgtgtggcatcccagggattcttccaggaggcatgcctcaggttaaaaggatccgtgcggaaaaacagtgtgtcgctcggtatcaacggggaaaataacgggtatcccagaaaatgcttctccatgaaccggaaaagaacctttttttgtccggtttcatcgtgaagaatccgcatgccgagcggaagcgagatgattcccatccacatggtgctgcgatgaatggaaagttcggggaatgcgtaatgataggcatcgtacaggagcccggcaatcacgcgtttctgggcaaaagtcagctggatcgtatcggcggcgtggaattcacagggtgtcttgtggcgctttctggcaagcagttcggtgtcgatctctgtctcgagataggcatgtctggaaaaatagcttttctccttcttgtcatggtaatgcgtcatggcatagatatagggatggcatgtggtgtcgagcagatagtgccccaggaaaccggagatgtaggcttcggcaatgccccggtctgcggcggacgagagacgcccgtaactttccagcagtccgtgaaaaaaggcacgcggctccgtggtgtgtgcgagggcaccgagattgtggcggtgcagggcataggacggaagataatagaaaaacagatccggtccctgcagtccgaacgcataagcgctgcggttataaaacagattttttttctgggaattacattttaactggtgatagatttcttcgccaaacagataatgtgtaacaaaacctggcatgggaattcctcctttcgttcatcatgagtataaccattttacaggaaggtgttaagtgaggaatggaagatttaagaaaaatgtaataaaacaaatagattgacaatcaaaaaaagagtgttatactatcacgtagtaatggaaactatataatatagttcggcgataatcaaaacagtcagattgtcataagatgatagacaaaacaaggaaaatgtatatcgggtggcaacacttaaaatgcattgcatatgtaaaaaaagagcagtattccttatactttcatcttagaaaagaattagtgtgtatggaagaaaacggaggattaagtgatggcaaatttagcacagtcagtagagagaaaggcattcagcgtggcgattgatgcagcattgaagcatctgaataaggatcgtgaaaaaggcctgcttcagattgttgatcttgcagaaaagttcatgggcgataacttccgtaaggaagcgtatgacggagccagaaagatgattcaggatccggacaataaatggatgcattatgtaaatcgtcttctggatgagaccgatccccatgtagcaaagatgacagcattaaatctgggatatcaggcagcatttgtgggaacgaagacgattcgtaagatgagggaagtacataactgtaacatcccgtggctgatcttaatggatccgaccagtgcatgtaacctgcgctgcaccggctgctgggctgctgagtacggacacaagctcaatcttacgtttgatgagcttgacaatatcgtgacacagggtaaggagcttggtatttacttttatatgatgaccggtggtgagccgttagtcagaaaagacgatatcattaagctctgtgagaagcacaacgagtgtgcatttcactgctacacaaacggaactctcgtagaccaggcattctgtgacgagatgaagcgtgtcggcaacctgtccttatccatcagccttgagggatttgaggaggccaatgatttccgccgcggcgaaggtgtatttgacaaggttcttcatgcaatggatctgcttcatgagaacgggctgatcttcggtaacagcgtatgctacaccagcaagaacatggatgccgttacatcggatgagttctttgatcttctgatcgagcacgggagccgtttcgcatggtacttccatctgatgccggtaggtatgaaggcttcaccggaactgatgccgaccagagaacagagagaatatatttaccacagaatccgtgaggtacgtggatttacaggcggtaaagagatcttcgttatggacttccagaacgatggagagtatgttggcggatgtatcgccggaggaagaaactactgccacatcaacccgaagggtgatgttgagccgtgtgtatttattcactattcaggagcaaatatccgtgagaagtctctgttagagtgtttacagcagccgctgttcatggcgtacagagacggtcagccgttcaatgagaacatgcttcgtccatgtccaatgttagagaatccggagctgctccagaagatggtacacgagagcggtgcacactcaacggatgttgaggaggcggagccggtagagcatctttgcggaaaatgtatggagtatgcatgccagtggaaagagacagcagataagctgtgggcagagcatccgtaccagcagaagggctacaccaactttaagaaaaaataaggggcgatcgttatcagcaaggcgaaaaaacagatcttaaaatgggcattggtacttgtcatcatcggaatcattgtttatacattccgggattcagcaggaccgatcttagaacaattagaaaaaacgacaccggcggtcattgcaggcatctgtgcaatgactgtcgtgtatcactgtgtcgagggcgtgattaccacgctgcttgcaaaacaatataatcgtgaattcacattaggcatgggtattaccaatgcctttttgtgctctttttaccgcgtggcgacacttggcagcggagcaggggttgccgcgattgtctatctgggagagcacggtatagagtattccaagagcttcggaatgtatatgctgcagtacgcgtttcataagatcagtatcgcgtttttctcaatgattctgttcgcactgaactggaattatatgcgggtacattttggggagtatatgtggctgctgttggcgggatatcttgtaacgctgatcatcaccgtggttttaattctgttcagctgttccaggcagtttcaccgcatgttgctttgggtggtggatttcttcaatggaaagacgaaagggcggtttgatccgcaggcagcaatgcttcatgaccagtgccagatgttggaggatgcatccagacagttgatgggagagaagcggctggttgcgggtgcagtgggattgaacctcatcaagttcgcattctggtattccatcccgtatctgatctttctggggcagggggagattacgctcccgcagacgatggcggtcacatcgctttctgtcatgcttgcggcagtcattccgtcaccggcgggaatcggctctaccgagttcgtctttactgcactcttttccggaattgtcggaaccggactggcaggctccgcgtcgcttctgtaccgcttcggtaccttcgtattcccgtttctggtgggggcggttgtggtcatcatacgccgcatctacctcaaaaaaacgggacaagccaaacgatagcgccgcctgtgatatgaggctggtacacagggcggagaatagactggcagtgatacgataacagtaagtacagcagagttccagaatagaaacagtgcgtaggaattcggatcgcaaaatacggaatttctaactctgccgctttttacatctgtgatgatccgtgtttttccaagttttgagcactccgcgggtgtgtccgcaggccgacagacaatttaaggacttttgtgtgttccttacatcaccaatgaacaaaacataaccgcgcgaagccgatgtctgaattggcatctgccttattttcaatagcagatgccaacgagtttcggttcgcgcggttttatattgtctgtgaagcggtgatgttaggaacactaaaaagtccgctcattgtctgcggcgtgtcggacacatcccgcggattgtcaaaacgtggaaagacacggaattggatataaaaagcggcagagaagaaattctcgcattttgttccaacgaatatcctatgcactgtttctatctggaactttattgcatcttacattttattgtgaccggcaatctattctccgccctgtgtgcgagcctcattttgcgcctcttttgaaaagtttaaggtttgggaaattgacaaacgcacaagtcatgataaaattaacgttggcatgcaaaaaatatgtaaagaaagcgtaaataaggaaacatatgaaaataaaattatattttgacaagggtaatttgggcagacttgcggtggcgatgatctttgccgcggtattgttctggaaaatcggcttttcggtgtgggcgctgccggtattcggagcgtgctacttcctatttaagagcctggaggtggaactgtcagagaagatcccgtgggtctggaccggactgatgatcggcgccagcagtattttcacggcgtatcatgtgcagtatctgctgctggatgcagagcttcgcgccaagatcacacagccgaagatgctgctcaatatcttgtgctgtctggtggtatttctggcggtacaggtttttaccaataatacgggacttacctgcatgatttcccacatttttctggtgtcattggcgggaatcaactatttcgtatatctgttccgcgggaacgaatttattttcagcgacctgaaatccatccagaccggactttcggtggcgggcaattatgagttcgtgatggatgaccgggcgggctatgtgattctgatttccacgctctatgtggcgctgatccgcaagcttcacgtttcctttaaaaagagagtgccgatggcgatcatctgtatctctcttgccgtgctgagcggcgtgtatatcggtcataagacggagtacatagtgacagagacctgggagcagaaaggaagctaccgcaacggatatattctgaattttgtgctgagtgtaagagattgttttatcgctgcgcccgacgggtattccagtgaggcggtgaaagcgctggaagaacagtattctggcggtgatagcggcgggaagaagcagggagagaaagacgctgcctcggcatatgcggatgtggcggctgatccgggagaaaagccggccattatcgtggtcatgagcgagtcgtatgcggatctttcggtggtgggagatttttccacgaatattgatgtggcgccttatttccactccctgaaggagaatgccattcacggatatgcgctgtcttccgtgttcggtgcgaagacgccgaattcggagtgggagtttatgaccgggaactccatggcatttctgccgagcggttccgtggtataccagcagtatatttccaagacgccgacctcgattgtgtccaacttaaagaacgacggttatacctgtgtggcaatgcatccgtactatgagaccggatggagccgcaatgcagtgtatccggatctcgggtttgatgagacacattttatcgacgattttgaccagacgaagcttctgcgggaatatattaccgaccgggaactgtatgagaaaatcattgaccgctatgagagccgtgcggcgaatgaggatctgttcatcatgagcatttccatgcagaaccatggcggttatacggaaaagtacgataattttgatgagaaggtacgcctgctgggcttaaactatccggatgtcaatcagtatctctctctggtgcacgagagtgattcggcgttggagtatctgatctcctattttcaaaatgtggatgatccggtggagatcgtatttttcggcgatcaccagccgagcctttcgtccagcttttatccgaacttaaacggcaagggactttcgggactgaccgaggatgaactggaagatctgtatacgataccgtttttcatctggacgaactatgagagcacggaggtggaactgccggtcaccagcatcaattatctctcgacgctggcactggagagggcaggaatagagcttccggcgtacaatcagttcctcgcggacatgatggagaccattccggcaatcaattccagaggctattattccaagtctgccggaggatttttgcatatcgaggaagcgacgggggaggaagcggactggatccggaactataatattttgcagtacaacaacatgtttgacaaaaaggaaaagagtgaagtattctttccttatctgaaatagtatcaggaaagcaacagagatgtagctttttagcgggcaatgtgtgtaagaaaaatgtggaggcaaaaaaatggagagagtgacacttggaaaaacagggattaccgtcaataagaacgggtttggcgcacttccgatccagcggatcagcacggaggatgccgtgaagctggcgcgaaaggcatatgatgccggcatcactttttttgataccgcgcggttctacacggacagcgaggagaagcttggcgaagcgtttgagggcatgcgggaaaaagtctatattgcgacgaagacggcggctgccaatgcggatgaattctgggagcagcttggcatttccctgcacaatctgcgcacggattacattgacatctatcagttccacaatccatccttctgcccgaagccgggcgacggaaccggactttacgaggcgatgctggaagcgaaggcacagggaaaaatccgccacatcggtatcacgaaccaccggcttgccgtggcagatgaggcgatcgagtcaggactttatgagacgcttcagttcccgttctgctatctggcgacagagaaggacatcgagctggtggagaagtgtaagcaggcgggaatgggatttattgcaatgaaagcgctctcgggaggattgatcaacaattcggctgcagcgtacgcgtttgaggcacagtatgagaatgtgctgccaatctggggcgtgcagagagagcgggaactggacgagttcatttcctacattgaacatccgccggtcatgacggaggagatcgcagcggtgatcgagcatgacagaaaagaactctcgggcgaattctgccgtggctgcggttactgcatgccatgtcctgccggaattgagatcaacaactgtgcgagaatgtccctgatgctgcgccgcgcgccgtcggaggcacagctgacgccggagatgcaggcgaagatgaaaaaaattgagggctgcctgcactgtaacaaatgcaagagcaaatgtccgtacggactggacacaccggcactgcttgcgaagaattacgaagattacaagcgggtactggcgggagaagtcagcgtaaaataagagatgcgcagacatgcagaacgacatgcaatgcgcgtaatgcacacgtgaggcgaagaggagtgggagaatgaagaaatacgagacagtcatttttgatctggatggaacacttttgtatacactggaggatctgacaaaagcgacaaactatgcgctgcgcaggatgaatatgccggagcgcacactggatgatgtgcgccggtttgtcggaaacggtgtggcgcgcctgatcgagctggcggttccggagggaacggcaccggaagtctttgagcagacgcttgcgattttccgggagtattatgatattcactgcaatgacaatacaaaagcctatgacggagtgattgatctgctccgggaactgaaggcggacggatatgcgcttgcgatcgtgtcgaacaagccggattctgcggtgaaggaactggcggagatttattttgagggaattgtgaaagtggcaatcggcgagagtgccggagtggcgaaaaaaccggcgccggatacggtctatgcggcattaaaggagcttggcatgccaaaggagggcgccgtgtatgtcggagattccgaggtggatgtgatgacagcgaaaaattccggtctgccgtgcatttccgtcctgtggggattccgggaggaagcgttcttaaaagaacatggtgcagatcattttgtccgcgaaccggaggagatcagagatttcctgaatgcgtaggtctgttgagaaatgtttcacttttggtaaggaagtaccattgcatgatttttgtacataaagtacaataaaaataatgagaaacacagaagagttgtgcggaatcacaacaaggaaggcggcatggtatgaacagaagaagtgtgaaacatacgttaacgatgacctgtctgatgctggtattactggcatccctgttgcttggggcaacttccattttcagtatccggaatacgaccaatatggcgctgacggaatatgaaagtgcgatggattccggttacaacacagagatcaagtctgaggtccagacggtgattgctgtgctgcaggcagaatatgataagagccaggcaggggaactgacagaggaagaagcgaaagcagaagcgaaggagatcgtccgcgccatgcgttaccgcgatgacagaagcggatatttctggattgatgatacggattacaatctggtaatgcatccgattctggcggagcaggaaggaaataaccgctacgatctggaggatcagaatggtgtcatgatcatccaggagattatgaaggtctgtaacagtgccgatggaggcggattcaatgaattttactttacgaaggctgacggtgtgacggttgcgccgaaggtagcatattccgagttgtttgcaccgtggggatgggcagtctccaccggtaactacgtcgatgacatgcaggtagagatgacgggtgtggaaggacgcatcaaccagaagttcgaggttctctgcattgtgatagtcataatgatggctgttatgcttgtgatggcgttcgtgtgggcgagaatctatgcggcgaagctctgcaagccgctggtggagatccaggggctggcatccagactttccgacggagatctgacaacgaccgtgaacgtaagggagaagaacgagctgggagacacggcagaggcactcaatgccgcgcagaagcagattgtttccctgataggaagcatcagcacggcatcaacagatctgcggaatgcactgcagtcgtttactggtaatttctcctcgatgcaggagtccatcggaaacgttgcggttgccgtcaatgagattgcggaaaacagcacgacgcaggcaggatccacgacggaagcgtccaacggtatcatgacgatcgcggaaggcatcgagaagatctccagcgagatggaagaactggtcggcaatgccaatcagatgcaggagtattccgataagtcgctcgctaagcttcgtgaattgatcgatacgaacaataagacagaggcggatatcgagtcgatgtatacacagacggagagtaccaatgcatccgtcaataagatcagcaaggcggcgacgctgatcagtgagatcgcagatcagacgaatctgctttcactgaatgcttcgatcgaggcggcgcgcgcgggagaagccggacgcggatttgcggtagttgcggaagagatcggaagtcttgcgacacagtcggcagatacagcgcatgagattaacgacattatcggagagctgacagagaattccgagaagtcgatgggcattatggtacagatgaatgatgcgtcgaagcagcaggtagaggcgctgaatcataccagcgagatgtttctggatatgcagaaggcactggaggcgtgcacgaattccatccgcgtggtgacggatatgatccgcactgcgaatgaggagcgtgagaaagttacccagagcatcgaggtgctgacgcatcttgcgacagataatgcggcatccacggaggagacttccagtatgacaactgagctggagggaacggtggagcgctccagtggaatgatcgagaagctggagggcgacatgaaagtgcttgcagacagcatggagcatttccggttgtaggaagactgcggcaagaatacaaatgataagatgagaatgaaagcgggcgtgtcagaaactgacacgcccgtaatttcatgtctgcagatattctgcgaatgtgaatatatactgggtacgaatagggaaaaaaccttttatatttcacatgcggcatcatatgctgatttaatggcatgatcgatattgctcggacgctctccggcacaatcgccaatataatgaagcgggagcggacaagccgaaagatccggaagattctttcttgcaccaacagccattacaacgaaatccgatctgatctctaagaccgaggttttttcattttctgttttctcaacaataactgcatggtcattgatctctgatagttttgcagaggtaaggatctggacattggaatgctctaattcactcatcaaagttgggagaatcgtgctgctttcttcctttgcaatctgatccatcatttcaataattgtaacgttacatccgcgggcagcaaggtattccgcagtttcaacacctacaagaccaccgccgatgacagatacgttgccgaatacaatttcttttttagcaagaatatcccatgcacttgtaacgattggaagatctttgcccggaacgggaatgattgcattcgttgcacctgttgcaacaattacttcatcaaacgaatcatagtcttttccggtaaattcctgacccagacggaatgtcactgataattcgggaagcacgttaagatagtagttaatgcttctcatcatttcttcttttcggggtggaacgctggcaataagaagctgaccaccgatctggagtgacttttcaaatatagttacctgatggcctctcagagcggcgacacgtgctgcttcaagtcctgcaattcctgcaccgataattgcaattcgctttgctgtgactgcaggagtaatctgacggcttgtctcataaccattctcggcatttaatacacagcttaggaatgcacggttttggatattgtctgtacatcctttattacacatcatacatgttctgacatcgcagcagtgtccatcggcacacttgtttgcaaaatcaggatcggtaagcagtgaacgcccgagtgcaacgatgtcagcagagccatttgtaataacggcttcagcagcttctggtgttacaatacgaccaaccacggatacgggaatggaaacgagttccttgatttttttagagtatgaaaccataaaaccatatggctgtgtccccatagcaggaatggtatcccccatatttccggtgtggttagcctgcgcgacatgcaatgtgtcaacaccggcagcttctaattcttttgcaaaaatgcaggcctcatcaagtggaagaccaccttttccccgaaagccgttatctccaagaggagttacgattggaagcttgtagtcgataaccatatctgggacaattgcttttaaacgtcgtacaagagttaaggcgaaacgtgtacggtttgcaaggtctccgccatattcatctgttctgtgatttaaaataggagagcagagcgatccgacaaggcggtctccatgtacttcgatacagtcaacgcctgctttgtgggctaaaacagcacaattttccatgtgcttaataatttcatccagttcttccgcagttacttcatttacaaagtgctgcatatcatggtgaagtttggctcttgcctcctgcatttttccctggtgaaacatttcgtttaaagctgcgacgttatagtctggatggaacagctggattccaagctttgcaccgtatttatgacatgcatcggcaagccgctggaagccttctgcctgttgaggagagtaaagttttggtgtaggagagaatgttgaaagaggagcaacgtctccaatgacaatgtatccaacaccaccttttgcaaggcgctcatagaaacgaaaactctgttcgccgatagatccatctttttcttcgtatcctgttgtaagtgggggaaacataatacggtttttaaattcaatgtttccaactttaatgggctctaataatttcattgtgcacacatcctttcaaagtgattatcttatttcaatggtgttaaaaactctaatatgagcctgtctaattcagctcttgcagaaccgcttgcaaagttgtgatttgcgccttcaattgttttgtaactgcatttgccattatagagtgcttcatatcgatgacaggtagcatcatctaccagatcgtctgccgttcctctgataagaagaacagcacctgtatatcccgctgcggatgaaaacggttcatactgatataaatcatggttaaaagaagtagggaagcaaagcccttctatatctgcttttgtgattccctgtgcttccattgcctcggcgcggtctttacatccaaaccacatgccggctcccgggcacatgagtatgagagcatgtggattaacgataggcgcagcagtggcagctgcatagccgcccatgctctggcctgataaaataattttatcaggattggcaaaatcctgctgttttgtccagtttataatatcttcgatatcatgtaagataccggtgaatgtcatgtcctcgaactcaccgtcgctttcgccatttccgtataaatcaaagcggacgctggcaaatccgttttcagccagaaatctggctgtgtgggtatagatatttttgtatccgcttttatttccggtaaatccgtgtacgttaatgatggcggggaagcgcgagccttcatccggaatatttacaattccgcgtaagacatgacctgagcggtttgttatttcaacttgttttgtcaatgcaagatacctcggtttctgaagttattctgcgtttgcagcatttcgtttgtctgataaattctgtaacatttcagctgttttctcttttgtaagagggtatacaaactttaatacaagtacagctaataagtacccggctacatataatccggtatatgttttccagagacgtccggagaatgcttcgctctgaacggcctcatttacgttaaagcctgcgattgcaagtgcaaagctgctcatacttccggatacggcattagcaagcttacggaaaaatgtatatgcagagtacacgataccttcgttacgttttccggtctgaagttcctgatagtcaattgcgtcatttacaagggcccagactaatacctggaaaccgctgacaccaagataacagattccgttgataataataaagagcattgggttctcaagagggaaaaagaataaaatagcataaacaacaactgagaaagttgcactatacataatccattctttctttccaaatttctttgcaacaaattttgtcccaatgaatgcgataagcgaccagataacgcttaacatgcctgaaactgccataatggcgacatttccgaaatagtcacggaataagtaggtatttaagccgtttaccataccggcaccaacgataccaataaagctggataacataacaccaagtaaagctttgtttttggagatggctttcagcacgtctaaatagttaagcttctctttttctttggcaactggctcggtgataatacgctccttgcaccagtgtgatgtaaacataaggcagatgaaaccgataacagcacagatggctgccataataaggaagtggcttggtacaggctggttgtctttgtataagaataatggaccggcaataacgatgacggtcataaagattgtgccgccaagacttctgaagcgtgaaaggtcggtccgttggtttacatcatctgtcataacacttgaaagacttccaaatggtacgcttacacatgtgtacataatttcatatacaacatatgtgatgaacatgtaagcaagacgggcaccataagcaaaattacttacgttgacgaagcctaagatacaaaggactgcggttggaaaagcaaagaatttaatccacggaatgaatttgcccttacccttgttctggtgactgtcaacaagtgcaccgattaatggatcgtttatggcatcccaaagctttgtgataagcataaggattcctacgtgcaccgggttgaccttcagcaccagggtataaaaaatagcaagatacatggctcggaactgttctgtacagcaacatcccaaatcgccaagagtgtaaccgattttgtccttcatggaaaatggtcttgtttctttcataataaaatacctctcgtttttgtgttgttttggtagctacatgttcattatatggggattagagagataaacatatacaaaaattgcttgcaaactatggaaaattgatgtattgtataaattgacaaaatgaacaaaaatatggatgctggaatgtgcaaaattaacatatgaaaaaacagagttatgagatggaatatataaaaatagaagatagcggacagcgcagttttggacagaagaaaaaccatacaattatttttgtgacaggtggtatgggatatttacgtcaggaaaatgaaaaggcggtctgtaccatggaggacttaatatttattaagcctggcaataaagtgaagattgaatatcgaaaaaacaaatatccgttagaactatatgtgctctatgtgggaacagagttattgcagagcttatcagatgaaaatacaagacttgacgaggcatttgatatcgttccctttcaggttaagacagttcattctgagagtgaatctgccatgcttataaagaatatttccaaaaagctgtattcaatgcttaaggaatctcctaaatttgcgcacacattgtatgagaaaagcctactgacaatgcttctggtacttgcgttgcggtcgtctgtcaaggaggacgtacagctaaaattaaataagaaaaagcatgttgtaatggatgatattttcatatatataagagaacacctgacagaagatatatcattggagcgcctggaaaacgagttttatgtaagccgctatcatattgtgagagaattcaagaagatgacaggcgaaacgccacattcatatattgtaaagagcagactggatctgtgcagacactatatagaacagggaaaaagtatccgtgaggtttatgaacttggaggatttggcggatacaatcattttttcagggcatttaagaaagagtatggtgttactccaatgcaatattataaaaatctgcagatcgataggaatgaaagataaattgataaaaacagcagtatcatgtttgaaataatgcaatgggtagcggacagtttcccgaataaatttttcagttttcccatatactaactcccaagctaatatatagcaaataagagaggctttatctacagagatggaaacagacaaagcgctcttgcgaaaataaagcattggaggaaaatttatgaaagcaacgggaatcgtgcgtagaatagatgatctgggcagaattgtggtgcccaaagaaatccgcagaacgcttcgcatacgtgagggagatccgcttgagatatttaccgaccgtgagggagagattattttaaaaaaatattcgcccatcggagaattgagccagtttgccggggaatacgccgagagtctggcgcacacgacgggatatctggtgctgatcacggacggggatcatgtggtcgcggcgtccggcagtggcaagaaggattttgagggcaagcccatcagcggacagttggaggagatcatcggtgagcggaaaagtctggtagcttctgacgacgaaaaggcatttgtaaaactgacggcggacgatgccggcgagtacagacagcaggcaatcagcacgattatctgtgagggggacgccattggcgcagtgatcctctgctcacgggaagaacgggagaaaatgggagagacagagagcaaacttgcggcggcggcggcaggctttctgggcagacagatggaacagtagaacagaactggaaaaaggcatctgaaacagtgtgtttcaggtgcctttttgggcatatgccttgaaagaagccgggagacatggtaatctcataaagcaaatgagtttcatggaaagttagaaaggtggaaacatatgagcgaaaaacctgacgtgacgatgggggaaatgaccaaagcagatggaaagtctggcaggaaggtgccgaaaaaaatcatatggacgatcggcgtagtggctgtggcggcaattattttgatcattggaatttgcagcggagcatttttgagcagaagtaacaggattctgcttgcagcaagaaataccataaaagatctgcccacggttgttgagaataggaatgctgcagatattatagcatccgggaaatatacgattggtgtaaaaggggctgtcaggggaaaagactttgatggaacgtttaaatacaaagatacacagctgcaggcagggggaacgatttcacttttcggtagggagaatctggattttctggcaaacctggatgatgagcagctctgcgcaagcatcccgatgcttacagataatctgctggtatacaattacaaagaagagaaagacggctacatagtggatcttctgggagcggatggggttgcatcgatcgatgcggcacttcgtgaacttacctcgaaagaagaacagaacagagcggcgcaggagatcctgtccgtaatatacgatgagtacaagacgctcgatataaaaaaagcagaaaaagaagaattcatagtggacggcagcgccagaaaatgtaacgggtatgaatttaccgtcacagaggatgaacttctgcaggtaatggatggagtgaaggaggtatacgatgcgtattacggtggagcagcagatgcattgaagctgaagctgggggaggacttttcgcagctcagagatagagcatgcagtatgggggatatcaatgtaaaagtctatgtgtaccagaataaactggcagcggttgttacggaggcggaaaagtctgatacggcattccgcctgctgttcaagggaggagaatacagaatgcagaatctggaattgctcgcagaggatttggagggtgagcattccatactggaactgacaggaaaagcagcaggggaagaagggggctatgagtttttgattgataatggtgagcatgatataaaccttgtgatttcgatcagtggggaggttcaatttgaaaaaatgagcggcgacagaatagatgtgggcaacatgtctgaagcagatctgagaaaatttattttgcgtacggttggaacaatcatcacaagccacatcaggtaaccgcaagacggggataagaataccagtatcccggagagagatgtgacagcagccgggcgtgtgagtggagatgagactgtattacggtgcacggagattggaaagatacagagaagaacaaatatggcaaaataaagccaagatgtgtaattgttccacagtatggatctgtcctataatgaggacaaagaaaaaaggcggcgtctgacgggggagaagacgatcagatgctgcgggcagggggaaaacatggagaagtatggttttggcgtagatgtcgggggcacaagctgcaaacttggtctgtttacagacagcgggaaactgatggaaaaatgggagattccaacggataccagtgaacagggggaacatattatagaacatgtggcagcatcactggaacgcagacagagagagcgggggcttgcggatgagcagatcataggcgtcggcattgacacaccgggaattgccgggcgggatggagttgtcagaggcgctgtgaatctgggatgggaggcatgtccggtgcaggagcagttaaagatgcgcctgcagaaaaaggtctgtgtctgcaacgacgcaaatgcggcggctctcggagaactgtggcagggcggcggcagggggtaccgcgatatggtgatggtaacgcttggaacaggcgtgggcggagcggtcatcctgaatggaaaagtgctcgcaggcgcccatggaatcgcgggcgagatcgggcatatgaccgtgttccacaaggagattgagcggtgtgtctgcggaaaatacgggtgcgtggagcagtatgcttccgcaaagggactgatccgcataacgagaaaattattggagaaaaaggatccctacacgatactcgtcgacacaccggaactgtcggcaaaacagattctggatgcggcaaagagaggcgaccgtctggcactggatgctgtggaggttctgggaaaagcgcttggaagcgcgctcgcagccgtggcggaagtgatagatccagaggtctttgtgatcggtggaggaatcgccggggcgggagagatcatcctgcgtatcgtacagaagtattacagacccgatgtactgccggcaggtgcggacattccgtttgaactggcacgtctgggaaatgatgccggcatgtacggcagcatgaaacttctgctggacacctcagaggaaaaataactgccggatttctgaagcatagaatggcatatattttgtatggagagagagaaaacgataagttccagatgcagccggcagcgacaattctttggagtaaaatccgagtatttcttccgtgccacgtcggacatcgaattctgtgtctttccacgtttggacagttcacggggagtgtccgacaaaccgcagacaatgagcggactttctggtgccaacaagggggcacacacaaaagtcctaaaattgtctgcggattgcggacacaccccgtggaatgctccaaacttggaaaaacacagatcattgaggatgttcgacgcggcatggttagaaataccggattttgcgatcagaatgtcgctgccggctgtattctggaacttcgtattttctgacatctccatcataaaacatcgtccattccggcttcagaaatccggcagttatttttgggagagggtacatgccggataaacttgtgaaacatggcgcgacagtgtacaatagaggtaattaacgcagaacggagaagatgcagtttgaaatttatacatatcgcagacgtacatctcggggtaaagccggatcagggaaagccgtggagtgagcagcgggcgcggcagatctgggattcttttgcagatgtgatcggggtggcaaaaagagaaaaaccggagtttctgtttgtgacgggggatcttttccacgcacagccgctcaaaaaggaggtgcgggaggtcagccgccttttcggagagattccggacacacaggttcttttgattgccggcaatcatgattatctcagggaaaagtcgtattacctcgcggatttgtggccggataacgtgacagtatttaagaaagaggaagcggaagcagtcgattttccggaatacaacacgaccgtatacgggctaagctactggcacagggagatccgtgacagacggtatgatgatctgcgccctgtaaaccgcagcaggtgcaacatcctgctggcacatggcggcgatgagcgccatattgcgttttcggcggagcggatattacagaacggatttgattatattgcggcgggacacattcacaggagcggctggctcatgccgcacaaggcggtaatggcgggaagcctggagccgacagactgcaacgacaccgggccgcacggatactggatgggaacgttcggtgcagcgggggcagatgtgtatttttatccgctgcgccattgcgaatattgtcatgagatgtatcaggcagaccggaacacgacagaccgtatgctgtgggactgggcaaaggagctgttggagcagagaccggagtatcagtatttccgtctgtatatcaaagggaaaaaagatccggagtattcctttgatgtgcaggagatcgggaagctcgaccggattgtggatattacagaccagacggtgccggattatgattacgagaagctgctggaggagcacgcggattcgatacttggggaatacatacgcagtatgcgaaaaaaagaaccgggcgtctgcaccgcaaaggcactggagtacggtgtgaatgcgctgctcggctatgactgctgacggaatgcctgaagtatgacaaaaagcaaaggatgggacagacatgcagattgacagagccgcaatttttcgctttggaaagctggcagatagaaccgtggattttgccccggggatcaacattgtatatggaaaaaacgaagccggtaagacgacgctgcacgcgtttctgaccgcgatgctgttcgggctggaaaaaggccggggacgggcaaaggggacggagggctatctgcgctatgagccgtggcatgcaccgtcctattacagcggcgcgctgcagtttagcgtcggaggcagaccgttttatctggaacgcaatttttaccataaagaaccgagagcacgcctctgcaatctggcggacggggaggaactgtccgtcgcgtacggagatcttggaatgcttttaggaggggtcacccgggaggcgtatgagaacacctgtgatattccgcagtgccgggcggtgacgggagcagagctgaccggacttctggcagagtatctttccgatatgtcggacgggggcaatgcgggaatccgcgtgacgcgtgcggtggaaaaactggagcagaaaaagagaagcctgcagtcgcagatcaaaagtgaacaggagaagcgggaacaacagctgcagcagcttaccgtggagcggcgcatgctcgaggaggactgcggcaggcttcgtgagcagatcgagaaggcggcagcggatatgcgggcgtatgccaggatgcacccgcaggtgagagacggacagcgaccggaagatgcccgaactgcggaaaatgcggggactgcgtcagacagggaaaggagagctgacggaaacggttttcctgtgagaagcctttttctgggactggcggcagcagtgggactggcaggaaatgcatggtggtatcaccgcgcgggttatgcgccggagctgtttgcggcggcggaaggcgttcttgccattctgctcggcatcggagtggcaggcatactgcgccataggagcgcggggcaggcgcgtgcaggagaaaatgggaaggagacggcggaggcgccagagagcgcggcagcggaggacgcggtgcgcatccggcttgcggagtcggaaaagcagagcagacgcttgcttgcagggttggaggaaacactcgcggagaaggaaacgagacgatgcaatctggcagaacagctggaagtatgcagcggagcgggcgcacgggagagagaactccagctggaacttgatgccgtcgagatggcaaaaaatgagatcatccgcctgtcaagggaatacggggacgagcggagagatgagatcaacagtgtggtatccagatatgtctctgcgattacagagggaaaatacgatctggcggaagtggacgaaacgggaaagctccgcgtgcagacggagggaagagaggttttgccggaggcgctcagcagaggaacgctggaacagttctattttgcgttccgcatggcagtcggaagcattgtgacacaggaagaaccgctgccgctgcttctggatgaaacctttgcaatgtatgacgatgaccgtctgcggcagacgctgcggctgctggcggcgaacgggacgcagacgatcctgtttacctgccagagacgggagcagaagctgttggaggaactgggaatcgcatatcacatgatagagttatagtaccgtttacgttgtaggcaaagaggggcaggacggcacagcgtgacacgcgagaaaagggcagggaggaatacggtggctgcaaagaaaaagaagaaaaaatatcggggattctggatatttgtcaaagtacagtttgtcctttccctgctggtgctcggcgggctgggctactatgtccttggcggatatgcctcagaggtgggcagcatccgcaaggaagcggacagtctggtacggaattcgacggaggagacgttccggaggtaccgcacaagcgttgtgtatgcggctgacggcagtgtgatatccaggcttaatgaccagggagcgtcctattatctaaagcgcgacgagataccgcagcccgtgatcgatgcggtggtctgtatggaggatcagcgtttttaccagcacagaggcgtggatttcagagcgcttgtgcgcgcggcaaaatcactgcttgaaaaccggaagatcacgcaggggggaagcacgatcacaatgcagcttgccagaaatgtatttctgacgcaggagaagacctggcagcgcaaggtggaagagatttttattgcacagaatctggagaaaaaatataccaaggatcagattctggaattttatctgaataatatttactatggcaacgggtattatggaatcggagcagcaggcagcggctatttcgacagtgaggtcggggatctggatctctcgcagatcgcatttttatgtgcgattcccaacaatccaaccgtgtatgatccggttacccacatggatcatgcagtcgagcggcgcgaccggattctgggtaaaatgcgggatgacggcaagattacacagatggcatatgcagcggcggtagcggagaacattaccttaaagcggccggaggcgatggaaaaaaataattacgtggaaacgtacgcctattactgtgcgacccgtgctctgatggagcaggccgggtttgtgttccagtatcagtttgcaacggagggcgagagggaggcttacgagcaggcttacagcgaatcctacagcgagtgccagaagcagctgtacacggagggctatcagatttatacgtcctttgacctgcagcttcaggaggaactgcaggcggcagttgacgataccttatccgcttttacggagaaaaatgacgagggtgtttatgatctgcagggggcggcagtctgcattgacaacgatagcggctacgtgcgcgcgatggtgggcggcagggagcaggattttgacggatacacgttaaaccgcgcctaccagagctaccgtcagccgggaagtgcgattaagccgctcacggtatacacgccgtcgttcgagcggaattatacgccggagagcattgttgtggatgaaccggtggaagacggaccgaaaaatgcgaacggtacctaccttggaaatgtgacggtgcgcaccgcagtcgaaaaatcaatcaataccattgcgtggaagctctatgaagaactgacgccgcaggtcggtctgtcctatcttgagaacatgcatttttccaggctggatgcggcggattatgtaccggcgacggcgctgggcggctttaccaacggtgtgtcgcctctggagatggcggccggatatgcggcgctcgccaatgacggggtgtaccgcgagccgacctgtattatgcggatcaccggcgatgacggggcggatgtttatcttgcagcgcaggaggggcaggaagtctaccggcagaatgcggcgcggatgatgacggatgttttgaagggagtttttaccaacggtacggggcgcggacttggactgtcggatatgccgtgcgccggaaagacgggaaccaccaacgaccacaaagacggctggctggccggctatacgagatattacacgaccagcgtgtgggttggatacgatatgccaaaagagatggacagcctgatgggcaatacctacccgggaaaaatctggcagacatttatggagcaggcacatgaaggactggaatggctggattttctgccctatacgcagattccggatgcttcttccggggagacagacgcagaggatgcagcaacggatgagggaagcgcacaggaggaaacgccggcggagaatggagacacaccgcaggagaatgtgacggatacaccggacacgccacagggaagtgcgacggatgttccgtcatcttcacaggaaaacgggcaggggatatcggatacgccggatgccacacaggaacagccgtcagacgcttcgcagcagaatacaacaggaacgtcacaggaaaatgcatccgacgcagcgcaggaaaatgcagcgcagtcatccggggagaacgcttcggatacgccgcaggagacagcgcccggggcaccttaagagaatacaccttaacattgacagataagactggaaacgttatcataagcatgggtaaaggcatcggcagagtacataacggacagaaaacgatgcaaggatacaaatagggaacaggagaatggaagcatgaaaaaatatgcatttggagttgacgtagggggaacgacctgcaagatcggattttttgagacggatggaaagctcattgacaaatgggagatcaagacgaataaggaaaacggcggagcatcgattctgtcggatgtggctcaggcgattgagggaaagctgacagaaaagggaatctccaggaacgatgtgcagggaatcggtgtcggtgtgccgggaccggtaaaaaatgacggtgtggtacaccgctgcgtgaacgtcggctggggtgttgtaaatgtagaaaaagaacttggagatctgaccggactgaaggtgaaggcaggaaatgatgcaaacgtggcggcactcggcgagatgtggcagggtgcggcaaaaggctgcagagatgtcatcatggtaacgctgggaaccggagtcggcggcggcattattgtcgacggaaaagttgtagccggatttgacggagccggtggcgagattggtcatattacagtgaatgcacacgagaaggagcagtgtaactgcggacagtacggctgtctggagcagtatgcgtctgcaaccggagttgtgcgtgtggcgaagcgtaccctcgagaaggcatccgaagatactgcgcttagaaaacatgcagatctgaccgcaaaggacgtatttgacgaagccaaagcgggtgataaagtggcgcttgaagttgtcgatgaggtatgtggcattttaggagcagcactttccaatatcgcatgtgttgtgaatccggaggtcatcgtaatcggtggaggcgtctccaaagctggtgatattctcacggatgcagtgaagaagcactttgttgccacttcattccacgcatgcgccaacacaaagttcgtacttgcgggactcgggaatgacgccggaatgtacggctgcgtagagatgctcttagattaaaaagggctttcgcccgcgtgcatcgcactataaacgggatacgttttattatgggaagcagagactatcacgttccagatgcaaccggaggcggcaattctaagcgcaaaatccggtatttctaaccatgccgcgtcgaacatccttgatcatctgtgtttttccaagtttggaacattccacgtggcgtgtccacaaaccgcagacaatttaaggacttttgtgtgtgccccttgttggcaccactgaacacaacataaccgcgcgaagccgatgtctgagttatcatctgccttgttttcaatagcagatgataacgagtttcggttcgcgcggttttatattgtctgtgaagcggtgccactaggggcaccagaaagtccgctcattgtctgtgttttgtcggacacgccccggggactgtccaaacgtggaaagacacagaactcgatgttcgacgcggcacggaagaaatcctcggattttgcttcaaagaattgccgcctctggttgcattctggaacttcatattctccaatattcttataataaaacgtatcccgttttaaagtgcaaagcgcgggggcggcagtcctttttatagcgctgcctacgcttccacggcgcgtttgcggacttccgcaagtgcatgtgataccggtggaatgcagatgataatcaaggtgatgattgcctccggaacaaggtaggatgcctgatagccggcagaatatgccagcgggctcatgccttccggggcgtatgctgcgaaaaatacaacgccggagatcgttgcaaatacaaaacgtccgataacgccaacgatatatccgatctgaagtccccactttttcttattgaagaagccggcaagacccagagcaccgaatgccagcgggtagtccaagagcatctgcgggattgtgtagaaaatcggctccagtacgaactgcaccaggccgtaagccactgcggtcataatgccgacatacggaccataccagtaagcgatcagaacgatgaaaagcatggacagcagagtgacggaaccacccattggcatgtcgaacagcttgatcatcgaacacacaacggccagcgcgatcgcaacagcagagtagacgagctgctttgtggtcagtgcggacttgtgcgtggcgttcttgtggcgcacgatagcggcaacaatcagaagaagggcgatgactgcgatgacgattgcaataccgacggtagtcagatggacggaaccgtcaccccagccgccttccggtgtagcaaaaaagttattcataaaaaaatcctccttggtgaatatgtagccaggaggatttgtctgcgttattgcaaaaagcttccttacgccggtattatccggttcaagtaataagggtcaatgaacgatcatctctcagcagaatctgcacccctagcgttttcatattcgatattattataacgaactttactataacgattctatttggaattgtcaagtacgattgtgttcttctccagttcttctgtgagcggcgcaatctgtgtgagcagattggtcatgtcctcgaagagggaactcttggtggttccgagatcattggcgtgattgatatgctccataacagcgtcaaactgccgttcctcaaggctgaaggactggctgacttcgtccagcttctgctctgcggcggacatggcggttgtaatctgctggtgtacagtgtccgcaccgccggcagcggttgtgatctgatcgaacacttcatacgtggaatcaacattttccatactctggttcaaggcgtcctgcgaggtggaaatactggtattcaggttggcggtgccctgctcgacgtcgccgatgctgatatctaccgtgctgacaagactcttgatctcactcgcaagatttttgacctcctcggcaacgaccgcaaagccttttccctgctctccggcgcgggcagcctcaatcgaagcattcagggcaagcatgtttgtctggttggcaattgagatgatctgtgccatgcagtccttgatcttctgaacggaaacctggaaatcggaaaaggtgttctgcatttccaaaaagcgctcctgcacttctttggagctgtctttcaatccgtcaacacgctgctgtgcaagaccgacagagctggcaatgtcagatttgacggaagcaaattcaccggaagccctgtccacatcgccgaacagctcatgaaaggaatccagcttttcgcggagcgcggcattttcgtccagaacgagctggaatgcctgtgtgatggactgcagttcatctaaagagtgcacttcgctggtggagagctgcttctggtaatctaacaggcagtccgcaatatgcgtaacaggatgaagatctaagcggctggtggacgtggctggtgcagcagctgcattctttggtgtttttaatgaaaacatggaaatcctcctctttctatcacagattattcaaatacgacacaggtcatggtctggttgacgaactgctgattataatgttctccgaatccgatcagaccggcgtgatcaccgagtgtggacatggttttcagataatcttccatatggtgttcctgtgagaacagaaggtaacggaaaacacagttgatggagaaaacgccggaaatatggttgaaatcgcggcggatgcgctgcagcgtctcatccagaatctcgttgtaatcctgttcttccagaagaacgagcacatcggaatcattgacctgtctgtaacagcagagaccattcccggatacttcctttaaggaaataatacagatgtcctgtccgttcattttgccgagcggattgtggaaagtctggttgatgatattgctctcgctgatatgtaaggcatccatataagcctgcttggaagatttgccgtttaactcgccgacatagtatctgctgcggtcggtattggaagcgatgaagcggtagcctggcatcggtttgtagagattctccttgtagacagcaacttttcctccgttgtttttcacaaaagcgtagacatcggcgtcttcatagatcgttccgttgacagagacttttccgctatccccggtgccgccgacaagcggaattcccaccttgccgagaatgctgtggatcgtggtcagcacacaggcgtcatttccggtacacaggtcaatacagacggtatctttcgaacttgcgtggacattttttaaatcctgttccatgcgttcgatgtatttgacgggcatggtggatgcctgctccaaaacgttggcaacagcggtgacattgtcataaaaagcaaccagaccgactcccttttcgacgaccctggtactgtaactcatgccgatacagccaatgctcgggactcccgggaaaagggattccagttctgtaacgtgtgcctcaaactggtctgcgttggacatcaggataagaagtcccggagcgtgaacgccctgtgcagcttcttttaagtttcctgtctggctcattccaaaatattgtttcatcagcgaactcctcccacatcttattacgaatattgtaagcaattttgcatgatatttcaacgcattaacgcaattttagcgaaacgtttccaaaaaataccttgacaatcaaacaggacagacatatactttgaaaggcgaataatttgattatcaaaatatttgaaaagcaaataattaaaaggaacagggaaaaggagaagaaacatgttagaaaagatgagaccgatcattgcggagcagttaaacgtacaggagtctgagattaaagagaacacaaagttaaaggaagatctgggtgcggattcgctggatctgtttgaacttgtcatggcgctggaggaggaattcggcgtggagattccgtcggaggatctggaatcgatcgtgacggtcggagatgtgatcacatatttgaagaaccgcggggttacagcataggcgaagacagcagccgggacataccggtgtttaagggtaagaaaaaagaccggcaggaagaaaagaggagaagtatggaaacaagggtaagcagattgcttggaacaaaatatccggtcattcagggtggtatggcatgggtggcggaatatcacctggcggcagcagtgtcgaacgcgggtggactcggaatcatcggagcggcaagcgcgccgccggaagtggtaagagaacagatccgtgaggtaaaggcgcggacggaccgtccgtttggcgtgaacgtcatgctgctcaatccaaacgcgccggaagtggcgaagattgtcatagaagagaaagtgccggttgtcacaaccggtgcgggaagtccggcaaagttcatggaggcatggaagcaggcgggcgtggtggtcatcccggtcgtggcgagcgttgccatggcgaagatgatggagcgtgctggcgcggacgctgtgattgcagagggaatggagtccggcggacatatcggtgcgcagacgacgatgacgctggtgccgcaggtggcggatgctgtgtcggttccggtcattgcagcgggcggtatcgcggacggaagagggatcgcagcctcctttatgcttggcgcagagggggtacagatgggaacccggtttgtcgtggcgaaggagtctattgtacatgaaaattacaaggaacggatcgtaaaggcgcgcgacattgattccgaggttacaggcatgagcaccggacatccgatccgggttctgcgcaatgcgatgagccgcgaatatttaaaactcgaaaaagagggcgccggatttgaggaactggagcagctgacgcttggctccttgcgaaaggcagtgatggacggggatgtggtgcacggcagcctgatggcaggacagtgcgcgggacttgtgaaaaaagaacagacctgtcaggagatgatagaggaactgatggcgcagaccgcggggcttttaggtgacggagatttttgggaaaagaagagcgtcttcttgggacgcacatcggataagggagaatgacatgggaaagacagcatttttgttcccgggacagggagcacagtacatcggtatgggcagagatttttacgagcagattcccgtgagcagggacgtgtttgcggcggcatccgaggcgtccggtctggatattgcggcgctctgctttgaagaaaatgagaaaataaatatcaccgaatacacacagattggcatgctgaccgtggaggcggcgatccttcaggcgttgcttgcagaaggaagaacaccggatgtggcggcaggattaagtctcggagagtacggggcactgctggcaagcggcgtgatggagcagagggatgcgtttgcgcttgtgagaaagcgcggcatctacatgcaggaggcggtgccggccggcggcgcgatggcggcggtgctgggactggacgcggaaaaaatagaggagatctgcggacagactgcgggcacggtatccattgcgaattacaactgcccgggacagattgtaatcaccggagaggaagcggcagttgcggtggcaggcgaacagtgcaaagagagcggtgcgaagcgtgcggtgccgcttaaggtcagcgggccgtttcactcgcccatgctaaaagaggcgggagagaagctgggagaggcgcttgcggcggtaacactccgggagataaagctgccgtatctggcgaatgtgacggcggactatgtccgggaagcggaggctgtgaagccgctgctgaaacagcaggtgtgtgcaccggtacgctggcagcagtctatggagcgtctgcttgcggatggtgtgaatacgtttgtggagatcggtccaggtcatacactgagcggatttatgaaaaagatcttaaagcagaccgaagtcccggcagataccgtgcaggtatacaatgtggaaactatgggtgacttcaaggaatatatggcaaagtagaggagagagtcagatgctggaaggaaaggtagcgcttgtgaccggagcgggaagagggatcggcagtacgatcgcagaaacacttgcaagggaaggcgcgtttgttgtcgtgaattaccgcggatcgggacaggcggcacaggaactggcggagaaaatcggcggagtcgccatgcagtgcgatgtggcggattttgaagcctgcgaaaacatgatcaaaacgatgatagagacgtatgggcatctcgatattttagtcaacaacgccggaatcacaagggacggtctgctgatgaagatgagcgaggcggattttgaagcggttctttcgacaaatctgaagggaacatttcatacgatacggcacgcgtcccgctattttttaaaacagcgttatggaagaattgtcaatatttcgtccgtgtccggtgtgatggggaatgccgggcaggcaaattacagtgcaagcaaggcgggggtgatcggactgacgaaaagtgtggcaagggaactggcgtcgcgggggatcacctgcaatgcggtggcacccggttttattgagaccgatatgacggatgccatgacagagagcgcaaaggaagccgttcaaaaacagattccactggggagatgcggaaatacaaaggatgtggcagaacttgtgacatttctggcatcagacaaggccgcgtatatcaccggtcaggtgatctctgtggacggcggcatgtgtatgtaagggagtagtaactgaaagaaagtgaggcaggtatgagaagacgggtcgtagtaaccggaatgggcgtgataacgccgatcgggaactctgtagaagaattttggaatgcggtgcgggaagaaaagacaggatttggggaaatcacgcattttgacgcatctggatataaatgccatctggcagcggaagtaaagaattttgacgggaaaaattatatggatcccaaggcggcaaaacgcatggaactgttttgccagtatgcggtggcggcaacgaaagaggccatcgcggatgccggacttgagatggagaaggaagacccgtatctggtgggaacagcgatcggaagcggcgtcggaagtctgcaggcgatcgaacgcgaatataagaagcttctggaaaagggaccgggacgtgtcaatccgcttctggtgccgatgatgatttccaacatggcagcaggcaacgtgtcgatccagtttggcttcaagggaaaaagcatcaacgatgtgacggcttgtgcgaccggcacgaatacgatcggcgaggcgttccggagcatccagtatggggaagcggatgtcatgatcgcaggaggtacggagggcagcatctgtccgatcggaattgccggctttacggcgctgacggcactgtcgtccgagagcgatccgaagcgatgttccctgccgtttgataaggagcggagcgggtttgtcatgggagagggcgcgggaatcgtcgtgctggaggagttagagcatgcgaagcagcgtggagcgaagatttatgcagaggtagccggctacggatgttcctcagatgcctaccatattacatctccggcggaggacggtgcgggcgcggcgcgtgcgatggaaaatgccatgaaggatgcgggggtaaaaccggacgagattccatacatcaatgcacatggaacggcgacacatctgaatgatctgtttgagacgcgcgcaatcaggcttgcgtttggggaacatgccacgaagcttaaaatcaattccacaaaatcgatgatcggacatctgctcggggctgcgggcgccgtggagtttgtaacctgcgtcaaggaaatgcaggaaaattatgtgcacgcgaccgtcggctaccagacaccggatgaggaactggatcttgactactgcagggaggcggtggcgatggaggtgccgtacgcgctcagcaactcccttggattcggcgggcacaatgcgagccttttacttaagagatatggaggcgaggcgtgatggaactggagatcggacagatcatggagatccttccgcacagacagccgtttctgctgatcgatgcggtggaagaactggagcccggaaaacgcgcggtggcgcgaaaatgcgtcagctacaacgaaccttatttcggaggacatttcccgggggaaccggtgatgcccggggtactgattgtcgaggcactggcgcagaccggtgcggtggcaatcttaagtatggaggaaaactgtggaaagaccgcgtattttgcggagattaaccgtgccagatttaagaaaaaagtggtgccgggggatgtgctgaccctgacgacggagatcatccggcagaaaggaccgatcggcatcggcagtgcgacggcgtctgtgcgcggggaggttgtctgcacggcggagcttacgtttgcaatcggcagcaaggaggagtagaggaaaaatggcggctttgtttcagaagcggaaaaaagaaccggcagaaaaaacaccggtggaggcagcacaggcgctgcaggagacgattgtgtgcccggcctgcggcagggagatcaataaaaaggaagcggaaaaaaatctgtatgtctgctatgagtgcggcagttatttcagggtgcgcaccagaaaccgcatccgcatggtggcggatgcgggaacgtttacctcgtggttcgaggatctggcggaggcgaatccgctggagttcccgggatatgaggacaaagtaaaagcggcaaaggaaaagaccggactgcatgaggcggtcaccataggtcactgtaaaatatacggtgaggacacggtgcttggcatctgcgacgccagatttctgatgagcagcatggggcatgtgatgggggagaaaattgcctgtgcggtggaacgcgcgacagaggaaggtctgccggtcatcctgttttgctgctccggtggcgccagaatgcaggaggggatcgtttccctgatgcagatggcaaaaacatctgcggcattgaagcggcattcggaagcggggctattgtatgttccggtgctgacagacccgacgaccgggggcgtgacggcaagttttgccatgcttggagacatcatcctggcggagccgggggcactgatcggttttgcgggaccgcgcgtgattgagcagacgatcggggaaaagctgccggaaggttttcagcgggcacagtttcagctggagcacggatttgttgacaggattgtggagaggaaggagctaaagcttaccctgtaccgcatcttaaagctgcatcacaaaaaagaaggttatgccaatttcgatccggtgcgggaggcagactgcctcgaggcgacagaactgatgaaagagcgcgccacaaaggcgaaagcattgtccgcgtgggagaaggtcaaggcagcgagaaaggtggaccggctggcgtctgtggactacatagagcagatttttgacgaatttatggaattacatggagaccggcagttccgggacgatccggcgattgtcggcggtgtggcgtatctggatggccagccggtcacagtgatcggtgtgcataagggaaaagatttaaaggaatgtatgcaccggaattatggaatgccgtcgccggagggatatcggaaagcactccggctgatgaagcaggcggaaaaatttaagcgtccggtcattacatttgtgaacacctccggcgccttctgcggcatggaggcggaggagcgcggacagggcgaggcgatcgcgagaaacctgtatgagatgtccggcttaaaggttccggttctttgcattatgatcggggaaggcggaagcggcggtgcgctggcactctctgttggaaatgaggtctggatgcttgagaatgcgacctacagcattttatcgccggaagggtttgcatcgattctctggaaggatggcagacgggcaaaagaagcgagtggcgtcatgaaaattaccgcgcaggatttaaaagcgctcggcgtgattgaggagatcataccggagtacggcatggcggatcagccggcactgatttccatatcgcgttacatgaagaggcatataaaaacatttttgaaaaaacagaacggaaaaaccggggatcagctcgctgcggagcgctatcagagattccgcgtgttttaaaaggaaggagacccgatatgaaggtaaagatcgtgggcaccggaagtgcagtccccgaaaaatgtgtgacgaacgatgatcttagtcaatggatggatacatcggatgagtggatcagaagccggacgggaattgagaccagacatctggctgtgagagagacaacgacagaaatggcagtggaggcggcgaagcgggcacttgcatctgcacatatggacgcggaggagctggagctgatcattgcggcgacgatcacgccggaccggctgctcccgaaccttgcctgcgaggtgcagagcgcactcggggcatgccgggcggtcgcctttgacgtcagtgccgcctgctcgggttttttatacgcgatggatattgcacgccactatctggaagccggcggaagccggcgggcgctggtaattggtgcggagacattgtcgcggatcatggactggagcgaccggagtacctgtgtgttgtttggggatggcgcaggtgcggcagtgctggaagcagatgaggcggaggagcatgcgggcatcttaagcaccgtgcttggaacggacggcgcgggcgggatggtattgcgctgtgacaaccgcagaaatcacaatccgtatgtgaagggcgacaccgcgctctcgtacgtgtccatgaacgggcaggaggtctataagtttgcggtgcgcacggtgccgaaagtaattgccggggcggtggaagaggcagggctttcgatggatgaaatcgattttttcctgctgcatcaggcgaaccttagaatcatcgaggcagtggcgaaacgcctgcatcagccgatggaaaaatttcccacaaatctgcagaagtatggaaatatttcctcggcgagcgtgccgattttacttgataatgtcaataatcatggtatgataggagaaggcagtaaaatagtactggcaggctttggagccggtcttacgtggggcgcagcagtgctccgctggcaggcggtgtaggcggtgtggtcgggaacagatactgctatgaacaggagtatgatacatgaccacggatgagacattgaacgaattactggtaaggctattcaaggatattatggagattgaggcgagatgtctggtgaatgaggaatttaaggacatcagctacaacgattttcatattatagaagccatcggattaaaggagccgaaaagcatgacggcggtggcaaagctgatggatgtcacgaccggtacgctgacgaaggcgatggatggcctgactgagaaggggtatgccgtaagagaacgcagcaagcaggacaaacgcgtggtgtgggtgtacttgacggacaaaggaaaagcggcatatgcgcatcacgaagagtttcaccgcaaaatgatcgccaacatcaagggacagctgaatgagcaggagacgccgattttgatctatacgctggcaaagctcgtggactattttcaagaggaatatggattggaggaggaatagacatatgagcagaggagcgttgggcaagaataactgggcgctgtttttaatgcttctggcaggaattatgctgggcggttttatcggaaatgctgctgcaggtgtttcgggacttagctggctgaattatgggcagagcttcggcttcgccagcccgattgtgctggatctgggcattctggtgatcacattcggattatcaatcaagattaccatcgccagcattatcggcgtgctgattgcgattattatttatcgcttgatttaagagatttgaaattaggaaagaatagccaaacgcctccggcaggagagagtcttctgccggaggcgttttttccggttttgctatcctgctataaagctttaacaatttagcggaataaagaaaaaaagattgcacatgaaaacattttatactaaaatgtatctgatgaaaatattgcagtgtatacacagcacaatatactaagagtaaggagacaaaaaaatgggatatgtagatgaagttcttgcaaaagtaaaagagaaaaatgcttccgagccagagttccttcaggcagttgaagaggtgctggagtctttaagaccggtgattgaggcaaatgaggaactgtataaaaagaatgcgattttagagcgcattacagagccggatcgtcaggtaatgttccgtgttccgtgggtagatgacaatggacaggttcaggtaaacagaggtttccgtgtacagttcaacaatgccattggaccatacaagggaggattaagacttcatccttctgtaaacttaagtatcatcaaattcttgggatttgagcaggtatttaagaattcacttacaacacttccgatcggcggcggcaagggtggttccgattttgacccgaagggcaagtctgacagagagatcatggcattctgccagagcttcatgacagagctttacaaatatatcggtgcagataccgacgtacctgccggagatatcggaacaggtgcaagagagatcggtttcttattcggccagtacaagagaatccgcggattatacgagggagttctcacgggtaagggacttacatacggcggttctctcgcacgtacacaggcaaccggatatggtctgttatacctgaccaacgcattgctgaaggatcacggcatcgacattgcaggcaagacctgtgcagtttccggttccggtaatgttgcaatctatgcgattgaaaaagcacatcagttaggagcaaaggttgtgacctgctctgactctaccgggtggatctatgatccggaaggaatcgatgttgcattattaaaagaagtaaaagaggtaaaacgtgcgcgtcttaccgagtacgcggcagcaagaccttctgcagaatatcatgcaaagcagaatggtgagcacggtgtatggcagtacaaggtagatctggcacttccgtgtgcaacacagaacgagctcgacatcgaggatgcgaagatgctggttgcaaacggcgttacatctgttacagagggtgcgaacatgcctaccacactggaagcgaccaaatatcttcaggcaaacggcgtattattcgtaggcggtaaagctgccaatgccggtggtgttgctacttctgcactggagatgagccagaactccgagagactttcctggacattcgaggaagtggatggaaagctcaagggcatcatggagaccatctacgcaaacatttcagatgctgcaaagagatacaatgcaaccgttggcggacagacagactacgttgcaggtgcaaatattgccggatttgagaaggtagtagatgctatgttagctcagggtgtttgctaattaagaaattctaagataatataagatatggttaagtcctgtaaacccagtgtttatgggacttttctttatgtattgaaatgacaaaagaattgtcagaatattcataaatagaagataatatacgttattttgaggtcgttatatacacgtggtacacaagtgatatacatgtggtatacacttgtttttactgattttggatgctttttaaagcgtttccatctgttacttttcaggatgattcaggctgaacatgagtgtaatgttgataccacaacaacattataagtgtattcagtttttgctcctaaatcttgtttacttctgtaagaagttcttctaaagtcttatgggtgtacgttcccttggtggtgtcgttcttcatactgtgtcccataattaatttgatacatacgtcatttgccccggcgctgtccataagtgaagcaaaggtgtgtctgccatcgtggggcagatgtttcattttgagttttcccatgcacgtattaaaattcccgttcatataggttccgtaggtgtaatgatttccaaacttgttattgatcaggtatttcttgttcggatcgtagcggttcttgacgagaggaataatcttatcgtttagtgggataattctgtctttcccggcttcggttttcatgccgccaaccatgtacttttcatctaaatggacattttccgtctggatttccaacagctcggttggtcgcaagccggtgtaaatcattataaggatgatatctacattgttgatttcatatagcttcgaccagagtgttttgatttcttcatcggaatacctgtcgtgtatctgctccgtagagtttgtccattcataaaccagaccttctgttaaatcccggtctatgtattcattcaatttagcgtattgatacatagccttcaggacggctcgcatagaagaaatcgtagtctgcgacttgtgattataggcatttaagcattgctgcagatcatttgtcctgatggaaataaatttgcggtcatgcagttcactgaaatgatgaaaagcaatctcataatttcgccacgtggaatcactaatctggtttttaagagattttcggtatttcttccatttctcgtacatctctgcaaaggtgggagagtccgagtatttcatatgttccggaacaaccgcaccgctattgtattcagctagataggtataagccatttccggtttggagaagtaagctaggtaggtgtattttcgcttgaccttcccggtatcgtcttccacaagtttcgagatacggacagcgtagggctttcgtcgtttgccaccaagcttgattacgctgccgtaagagtttggtaacttcatactttaaccttctttctgcatttgttctaattgtttaaggcaatactctgcatattccttgtagcgttttactcttgcaatttcatttggaatatcaaaagcataaatggacttcggaagcaggtcagaacgtttggtaggattagccactttgtacgcagagagcttatactcaacaaaatctttcacttctttttccagttctgccagcttggttaatggtatctgggcaacgtcttttccagactcatttgaatagacatggattacgccatcttcagcaatttcttttacatcaacagatccggttgcagtatcgaaggaatcctgtaaatgggcttcctgaagaagctcatattcaatcgtatagccgatatcatgcaggtaggagagaacaccgtaataaggctgttcatattcatcaatgtagtatttgcgtatttcaaaggaattgaaatagtcatcgatgattgcattaacaaaatcattggtgcactcgcagtattgcatcaaatctccattttcattaggaataaacgcttccataggtattttgtaaccgctggctagcactttgagaaaactctctgttacaggtttcttaccattctctacgttgcagtaatgcgttctggaaattccaaagtcttttgctaactggttctgtgataaccccctttcttttcgtatttgaatgatccgtccccggatttcatcttgatttttcagcatttttcatgtactcctttcatttacacatcatatttgctcgtaccatatgagaaacaggattgcttgcatgtactatatagtacataattagtatagacaacaacagcaacaatgtcaacaaaaatatggaggagaaacaagtgaaaaaagaagaagtaaaactgctgatgaagcaaaatcaggtaaagcagtgggaagttgcggaagcaatgggaatttccgaatttacgctttgcagatggctaaggaaggatttaaaagggaaacagcttgaacggctgaattcggcaattaagaaggtcagaagcggtaaagaggagacaaatggaaaggaggggcactaatggaacgagttacgacaaaagaggctgcaaaattgcttaacatggatgttgtgactttacagtttttgatgaggcaggagcggctgccgattggatatgccatcaagaaggatggaaagagccgctatcattacatcatttacagaagtatgctggatgcgtttatccagagtggagggaaatgctaaatggcagggaaacgatattactggttgaaattgcaggtcggtttctttcaggaactgattatcaaacaactgcaaactttgccggagggagacagtatcgtcctgctttatttgaaactgttattgaaggcaatcaatacggaagggattatttactatcaaaatattttgccatccttagatgaggaaatagcattggatacgggagagaaaccggcacttgtgaagctgacgatttctgccttgtgtaaatatcatgcggctgtgttcttggatgatcaatcattacagttattgtacttgggggacatggttggaagtgagagtgcttcagcatccagagtcagaaatcacagggcgaatcaaaagctcataaaggaaaaagagcaggcagcgttacaatgtaatgaaactgtaacggaaggtaacaccatagaattttcttgtagcacagagatagaaaatagtcagaaggaagagaaaaagccaaaggaagagggagaaccagagatagaggaaattccttcttactttgctgatacagtgctgaatagtatgtttctttcttacctggaataccgaaaagaaaatggcaaggaagtgaaggggaaagcaatcggttattgcattgataagctggaaagtctatcgaattctccagcagaacaagtggcaattattaagcagacaattcagaatggatggacggatttctttccgttgaaagggaaaaaggaaaaggtaagcggaagcaatgtaagctcatggttggagcgtgaaaagatacaaagtacgggaggtgctttcggtgactaaacaggaatttgcgacattagttgtagccatgcaggcaatgtatggagaagattttattgggacggaaaaagcgttggatgtgtggtacgctttattgcatgatctggactatcagattttatccaaggctcttcaacaatatatgctgacaaataaattcaagccaaccgttgcagagttacgagagatatatgcagagttggttagcccggtgattactgattggagtgaaggctggaagaaagtcagcagggcaatcgggcactatggaatgtatcaggagaaagttgcaatggaaagctttgatgaagttaccagagaagttgttaagcgtctggggtttcagaatatctgcctgtcagaaaatattgttgctgaccgggcaagatttgcagaaatctaccaagccatccaaaggcggaaaataacagaagtgaacgtaggaagtgcattgccgaacttacgagaaatggtgcagaatcgcttggctgaactggtacagaaagggcaaaattcaatagaacaggaaaaggataaaaactaacttagcaagcactgcctgtgttccctcacaggcgataaaatgagcgatttctcttatcgaaggaatgctcaaatttatcattcagggagaattccctaacccttaaaatcatttgaaaggatggaacgatatggcaaaggatagagcaaacagaacgaggaaaaatgagctgaagatttatttgagtgataacgaaaaatatatcctggacaggaaggtggagttgtcaaagaggaagagtgcatcggattatattaggacactgatactctttggatttgtttatgatgtggattattcttatctaaggcaatacaacgaaacgcttggaaaaatcagtgggaatctgaatcagattgcgaagagaattaacagcactggaaacgtttataaagaggatatggcagaagtgaaagtaattatggacgaggtgtggaagacgcagaaggcgatgttgaaaaaacagccgttgatacataataaataactcaaaaataataaggaaagaaattgaaggtatataattgtaaccaatgtaagaaaggtgccttgaggtataagcgatagattgatgacagactgtatggtataatttgtaagttgattctattatgtaagccgtaatcacagctattgcaacttaaaattgcttagttgcaactgtattttgatagtcttcacaagataaaaatggtacgctgagtgagaaaggagtagtgatatatgacattaggacaaagaatacaaaaaggaagaaaagaggctggcctatctcaagaggaattggcagagcagttaggtgtatcaaggcaggctgttagccgatgggagaatgataatggttatccagagatggaaaaaatcatacgtttaagtcagatttatcaagtgagcttagactatttagttggaaacgaacaagaaaaatcgggagaggatatatcagaaaaaggttggtatgtcagtaatgagttggcagaaagctttctggcacatcaaaaatcaaagtttatgaaaataggtatttgttttctactggcgtgtgtgtctagtgtgttttcttatatgaatatgtataacaacgttggtgatgtgattagtacgtttatcataatagttgctattattttgataatcagtatggttatatcagacaatccatataaaaagatttggacagaaccattggtttttgatgccgaagtgttgaaacgattaagagtgacatttgcggaaaataagaaaaagtataagataatgatattagggggcgcatttgtatttttaataggatttctgtttttaccagatttctattggactgttccagaagatttgcagtatatatggtatgcgttaggagatgcagtacagggaataggtggatgctttgcaatttatacatgggggatatggcgagcatataggctattaacaatgaatgaagagtattggaggaggaagaagaaaaaatgataaaaaggacatatttattaacaatattattaatagtttgtctgttgacaggttgtgggaacaaaacagaaaagatgtgccgtatcgaaatacgaaatgagaataacacagatgttataacattagaacaacagtctcaagctgatgtagatgatttttttgatgaggatgaatggaccgaatgcgagaactttgatgaaaaactggcttctgaatatgtaatagagctgtatcaagaaaagacacatactagagtgcaacctgataaagaaaatgcttatgagaaaatcatggaatataccacatataaggattcagatattgttaaggtagttattagcaaagatgccataaaaagtggtggtgtgtcagaagaagatttaaccttttactataaaggttcagagcattttttttcggcactcaataatgttttgaagtgatttctgaacttaaaattggatgaaccaatgggaatggaagcctattttgttataagggggtgagtatatgggaaaatgatgatactgacatttgaagatagtgaggaggaaattctaaatcatataatatcctgtgtcagtgcgggatcaagagcatatcaagtagttgaaaatgaaaaaaagaatttgagttttaatggattagaaatagatgatataaatcgttcggtaagaaaacagaaacaggaaatagatttgacatttacagagtttgaaatcctctatctgttagccaacaatccaggcagagtgttcagcaaggagcagatttatgatattgtctggaaggaatcttattccggcgattataacattgtcatgagccatatacgcaacatacgggaaaagatagaggataatcccagcaagcctgtttatgtacagacagtctggggtgttggctatcggttcaatcagaaaatgttataaaatatagccacattgatttcaacataaatcatgtggctattttcgtgaaaaatgtttttagagtaataaaagagatgacaaaaaataggcaaaatgtatagaaaaagagagggtagtgtgttatagtaaatatactgggtggactttatgtataacatattcgaaggtggtttatacaatggcaggtatatcaaaagtactggaaacagaattgaacggtttgaaggttaatctttttgaatttgatattgaaaatgaagaaagcttcaatgagataaaagcatatttagttaataaagtaaaaatatctaaagtacataatatagaagaatatgatttgacgtattatggaacaaaaaatttgaatccagattttgtggccagatttaatgagcaggttgcaaaaatcaatattcctaaaaaaacgaaaataccacaatttgatgttcgcagagaacgcgtaacagaatggatggcacagtatttgctagaacaagaatatggttgtaagttttatgatgaagctgataaaagagtaaatttgaaaaccgttgaaattgataaacatactgacgggatagatgtacctggtatttggatggataatgatagaattcgatttgttgtatgtgaggtcaaggcatctgaaacaaatcaaataccatgtgattctgtgcaatctttacgacaggatattcagaaagctattgatgatgtagacaatcgagtttctcacgaaattttggaatatatgcatggtataagaaatgttaaaatgcaggatgatatattagaaaaaatagtagactttttagcgaatttaattgctggagaaaaggaagacttagcagataatataatgtttttcccatttttgcttagaaataacgagaaaattgttccggagatgaacatagacgattataaaaatttttctttacagggagttaaaagagaaaatgtcgagaatataatcttatcatttagaaagaaattttctgaatttagtaatgaagtctatgaagaggcaataggtgaatagcaatggaatatattaagagcataattaattcaatagagaaagtatttgatgtaagcgaagaaaatatttcttcgcttactgttatgctcgcagatattgaaactagtcatttatataataagttttctgcaaaagaacaaagtaagaaatatttgaatagtgatttactttctaaggcgaatttgctgaatgcattattggaaattgttttagaaaatccaaatatggatttaattgagagcgacaaacgaaaagagttacttgtaggtttatgtggaacagtagcatccctgtatgagcaagttttagatcagattaatgataatgagtgttgggaaaatatgtcgtacttggttatgtatagtatgttatcttatatggcagatagacagacaatgtctgatttggctattaaggaatataatgttaaatttaccaaaatgatgagtttatacaatgaatttccaacgatgcagaaattagaatatgatacatattatctaattgtattgttgatgagtaatattaaaaattatgatggattgacacagttaaattcctatattaaaagagcaaatgataatttgaatgaggctcaaagggaggaactttcaaaagctgagttagatataccggttggtctaaagattgcttcttatggaaatattatttatttgacgatggttttaaaagaatatctttttagcggtgagattgatagttcggaaaatcaagatatatatagtgttatcgatatgtattcatataatgcatttcatttgctggataatgaaagcattgacttgaaacttattgggcatttgttgcgatatgcatatgaaagagtagcggaaaattcaatatggaacattgcagaaaagtcaccattaataagaaagttcatcgaagaaaacctttccaatggtaatagatacatatattctttattgccatctcagagagaggttatttcggatgtgttaacgcctaaaaagagtattgttgttggaatgccgactagtgcaggaaagtcgttgctggcagagatgcagatattatttagtattcataactataaaacagccgattttaatcctacagtttgttatattgttccaactaatgcacttattgatcaagttaaaattgatttgcaaagtgattttaaggaatttaattttaatatagaaacagcattaccatattatgatgttgatgagatagaaaatgaaattttgacgcgggagcatattgatatattaattagtacacccgaaaaattagaggcacttgtaagacaaaaccatccggcaatacaaaacactcgtttagttattatggatgaagcgcacaatttaggagacaaatcacggggttctaaatttgaactggtcttatcatctataaagcaaaatatgaaagaggcaaattttcttttattaagcccctttattagtaatgctcaggaaattagcgagtggttagccgactcaccaagaaatgcagatactatttccatagagtgggcaccaaccaaacaatatattggttgtaatttacttgatagtaagaaaacaaaatctgttctgcaattttacaaatcaccaagaaaccaattggggacagaaaatgttgaaatttccttgaacttgaacccgcaggatgtgaaagaagagcttagattagatagtattgataatacggttcgactttgtgtggttctgaatgattttattgaacaggaagggaatattttagttttgtgtggtggcagaggtaccactttgaaattggcatcttatacgaaaatgtattttgaagaaaaaggtatgctgcctgatatgagctgtgacgaagaaattcaacgtgcaatagagattgtaaagttagaaaatggagaaaatgatcctttaatcgaatgtttgaaatttggtatttgttatcataattctggcttatcaagtctggtcaaggaaactatcgaggaattagtccgaaacaataagataaaacttatatttgcaacaacaacattggcgcaaggaatgaatttcccgattaatacggttatttttgatacagttaaattgcgtaataaaggtgatttatcaaacgctgagttttggaatatagcagggcgtgctggtagagcatacaaggataaagagggatatattattctctcctattctaattcccagaaagaaaccaagtcaacagtgaaaagatatattgaatcagatttaaaagaagtaatatcttcactgaatgcttattttacgggaaatagtactataagtattgactacaatgtgttaaaagaaccaaataatgcaccaatattaaatctgttgcaatatataaatcatatattgaacattagctatgattatgatattagtccaaaagatattgctaaaattaggggaatattaacagattcttatttgtatcatagtttgagtaaacaggaaggttttattaatgcacaaagaaaattaaatacttttgtaacacaatatattcgacatgttaacgaaaataaaaaggaggatatggcgaaggctgatgaattaggtattagtgatataagttatacaaaggttaaatctataataggtgcatttatccatggactgaaagaaaacggagatcatgagtataaggcttcagaaattattcttcgaactaagaatattgagcgtttgacagagattattaatattattgcaaaaattcctgaaataaaaattgatatgttagggcaagggaagctggatccagaaaatatagctaagttacttatgggctgggtaaatggcgataaggtaagagatattgcgaaagaaattaaaagaccagggcaaagcgatgaagatgcaatttctttatgcaatcgttatcttaatagccagatgaagtcttatatgccatggggaataaatatatatcaggccgtgagctttgatttgcagacagaaaatgcacaaatgttaccttcttatatttattatggggtatcaagcaaggaagcggtaattgtatcgaagttgggcgtgccaagatttgctgttgataatgttttaaatattttaaaaacagaatattccagtgtggatataagtgtagctaattataaagaagtaaaagcggttatagagaaaatttcttcacaacaattaaaaattgaaaatgtaagtggcgaaattataaaaaatattattaaaaatcggatgaaatagtgtgatatgtaaaaactttgagataaggagaaaaaaatggctaaagttataacatttataaatatgaaaggtggggttggtaaaacaacgcttgcagtaaatgttgcatatacattatcaaaaattgagggtaggaaagtattacttatcgatatggatccacagatgaatgcaactcagtacacattaaaagaagaacaaatgcaagaaattttggaagatagaaataaatcagtttatggctgcctgtctccagattatcaagcaaattcagtattggaaggctatacaaaacttagtgaagaaaaatggatatttcatgtagatggttttgatattattccatcaagtttggatattatgacattgaatttatcggcaaggccgcataaattggatcagtatattaaaggtgaattgggagaaaaatatgatgtagtaattattgattgtccgccaactatatcggaatataccaaggtggcgctgcttgcatctgatatgtatttggttcctatgaaggcagatccattgtcagtgtttggtcttcctatgttagagaattatgtgaaagaaactattgaaaaggattttcaacatcaaatagaatttgtcggaatagtattaaatatggttattccagagagattgttatacaagaaaaataagccgataattcaaagaagatggaaaaataagttgtttcaaaatgaattaaagcaatgcgaagaaattgtgaaagggcttgatcctgaattgtctaatgaaaaatatatattggatatgagagatcctataattgttgatcaaataaaaaatataacaaagcaactaattcagagaggaaggttgtaattatgaaaaaagaaaccaaggatgcgttatattcattgttggatttgatggatatgttaggaagcattgattttattaaagtagatatagatagagctaatcgcattagaaaagaggttttggatgttattggtgataaaaaggaagtaacaattcttgatagtagtacagacgagctgttaggtgttttgccggttattttattagatagtaaaaaattcccgtctacaaaagaaattttgaagtttgccgaaaagtgtttgaatataaaaattaagaattattggcaaaaacgttctagggcagaagtggtagggataattattaacgaggtttatgagcagagcccagaacaatttaataattttttaaaggcatggaatgagtttagcaatgagacgaatcatcaaaatatgaatgcgaaacagaatgtagaaaatataggttttatggatgcgtggtttcagttctttgatagttataaaggtgttgaatgatggaaacatatggttatgagttagaagaagaatttaatgctgtagctcattttattaaccaaaaatatgggattaatataaaaacaaaagaacagtcagtagattttacaaaagcttcattaacatttatgttgtcggtaaagatatggaagaatcatttgtctccgtattttgaggtgacccccaaaacggaaatgtattttcaagagatattatctaatgctattcatataatattactaggaaatattgacatgaaaattccaacattgattatgttaagaagaacacaagaattgatattaacatatatttattatagtgaacatccagtagaattatataaaaaagaaatggatgataattcaagaacaatagggggattcaatgatttaaaagagtatgttaagaactatccattctcaatgaaatacaatcttgaagacaagaaacttcaagagctgatgtcaatggtaattggaaattggacaacgcagtatagggaattgtctaattatgttcatggaactaatagtaattttttccaaaagacacagtatgttgatgaatttaagtttgtgaaaaaagatataaattttttgactaaacaggtcagtatgttatctagcacggtaaatgttttgttaataattttttattttaaagaatatgtatactttgacgaacatacagaaaagtcattaatccgaaatgcaatatcaaacgaactggaatataaacgaaaaatagtagaaattttaaaagaaatataaaatgagtattccgttcaaaatgagcactactcatacggaatactcaaaaacaagaaaacagtataggtactaaagaatttctaattaaaagtatattttgagagaatgaaagatagatgataaagaattcgatactaaagtatagttaattctgtgttcttcgataattgttttaataattcatgtcctttcccaaataggtgttaatcgaaattctccgacaatcactctatacacgtgatatacaaacgacctcaaaaccccggtaaatctgcggacacctcagaagctgctatgctcgctcagggtgtttgctaatcgagaatttctaagataatataagatatggttaagtcctgtaaacaaatcaaatcttcgatttgactggtgtttatgggacttttctttatgcatatataagacatgtgaatggtgagaatattgataaatggaagggatgttattaaaaaaatttgaagctgtagaattttacgttgaattttacagcttaatttcgtataatatatgtaaataaagaaaagatatccaggaaaggaagttgattttatgccgaatatattacctgtatcagacttaagaaattataatgaagtgttgaaaaattgccaggttggagagccagtgttcctgacaaaaaatggcagaggcaagtttgtaattatggatattgaggactatgagcgtgagaaggcagagaaaaagctgttgatgaagctacaggaagcagaagaagcagttaaggatgaaagcgcctggatgagtttggatgaactgaagaaatctgtcggggtatagcctatgatgaaattacggattaattctattgtggcagaggacttgaagaaaatgaaagagtatattgcggaagacaatgaagaaatggcagtaaagaccattcaggagatatatgctcgaattgagaatatacagcaacttccgtatatgggatcggagcttgctaaaagggtcagcttccggacggattataaatatgtgatttgtgggaattatgttgtgctgtataagattggaaaagagtatgtggagatttaccgggtggtgaatcggcatcaggacattacgaagatattttaaattaaacggaagaaaatgatggaataacaagtaaaaataaaaataaaaataaaaatgcctaccttcgtacctgactggtggaaggtaggcatttaattaccatagtaattatgcgtaatatacaaaacgctatgaaagctttatttttaggtggttcttctatccttacaccatctctttttccccgatcttatttacgatcgtcctaaaaatccggaacatgaagaggatcgtcatgataatggagatcagctctgcgatcgggaacgcccaccagatcaggttgacattgccgaactgcgccagaaagtaagcaaccggcagcagtgcaaccagctgtcttgcgatcgagacaaacatactgtagactgctttgccgagcgcctggaaaatgctgctgcaggagatgccgaatcctgcaaggataaagcttaagctgataatccggagcgccgggacgccgagagaaagcatggtgtcggaagcgctgaacattttaagcagctgcgttgggaagagctggaagatcagaagtccgaccgccatgatgcagacggcataggtgaccgtgtggcgtaaggtcttgaccacgcgctcgcggctgccggcgccgtagttgtatgccatgaccgggatgacaccgttgttcagaccaaacgcaggcataaacacgaagctctgtaatttaaagtaaacgccgaacactgccgttgccgtggaggagaaactgatcagaatacggttcataccgtaattcatgaccgaaccgatcgcctgcatgacaatggaaggcacgccgatggcatagatctgaccgatgatggtgccgtccgggcgaaagccttttaaactcagctgaatctccttatttctggtctggttgatgacgacagcgagaaccgcagcaatcatctgaccgatgacggtggcggctgcagcaccggtgatgcccattttcggaaaaccaaacagaccaaagatcaggatcggatctaagatgatgttgatgaccgctccagtggtctgggtaatcatggtgtagacggtttttccggttgcctgcagcatacgctcgaacatcagctgggtaaagcagccaaaggacaggcagcagcatacagtaagatactgctttccgtagagaacaatttcttcaatatccgtctggctgcggaaaaaaggttccgcgaaaaacagaccgatgataaggaacagcagatagctgagcaataccagaaaaacagcgttttccgcaatcttgttgactttgtcgaaatccctctctccgagtgagcgggcgaggagcgcattgacgccgaccgcagtacctacacctacggcaatcatcagattctggatcgggaaagccatagatacggcagtgagtgcgttttcactgatctgagccacgaaaatactgtccacgatgttatagagagcctgtaccagcatggagatcatgattggcagagacatggatatgatcaatttatcgataggcattgtgcccattttattttcctgcatgggaaacctcctttgttgaatggtataacgttaaaacgacctttctatactaccattttgcggtagcgattacaaggcatggtgcaaggattggggaatcttttgtgaaacggtggcactgtgccgcaatttttggtaaaatagatgagaaaaaaagaacaacaggagattatacagatcatgaatatattattttttctgaccccgaaggaagatgtggcgcatgtagatgaggacgataccatgcgtcaggttctggagaagatggagcatcacggctatacggcaatcccgctgcttagccgcgagggaaaatatatcggaacgatcacggagggtgatttgctctggtttttaaaggaccgcaattttccggatttgaagttgcttgaggatatgccgatcacctccatccagcgccgcagggacaatgaggcagtcaagattgacgagtcgatggaagacctcttcggcaaggtgatgaaccagaacttcgttcccgtcgtggacgacaagcgtgtgtttatcggtattgtgacgagaaaagatattctggcataccttgggaagaaggccgccgcgcaggagaatggcgtgcggggcatggatcaggcatagtgatggtaagccatacgggttatgtgacagcgctttctgtcagaattatcagcaaataagtgagacagaacaaaagaatttcttaaatttgttatttttttcacaaaacagaatggtaatccgctataatatgaaggagagacaaggcataacatttatacaaaagaaaggggaatttacaaatgaattcaattttatcagcgacagtattgattccactgattgtgatcgtgctgctcatcgtactgctgtgcgtcggatacgtgaaagcaccaccggatatggcgtacattatttccggtgtcaagaagaagtccaaggtggtcatcggaaaagcgagcatccgcattccgttttttgagcgtctggataagctgaacctgcggctgattccgatcgacgtcaagacgagcaatgccgtgccgacagcggattacatcaatatcaatgtcgatgcgaccgtcaacatcaagatcagcaacgatccggagaagctgcggcttgcggcagagaacttcttaaataaaaacaccgagtatattgccggggtggcaagagaggttctcgagggtaatgtgcgtgagatcgtcggtaagatgaagctcgaggagatggtatccgaccgccagaagtttgccaacctggtcaaggaaaatgcggagccggatcttgcggcgatgggactcgacatcatcagctttaatgtccagaatttcgtggacggcaatgaggtcattgaaaatctgggtattgacaacattgtaaagatcaagaagagtgcggcgattgcccgtgccgagagtgagagagacatcaaggttgcacaggcagcggcagacaaagagtccaatgatgcagcggttgcggcgcagacggagatcgcgaagaagcagaatgagcttgccatcaagaagtccgaacttcagatggaggcggacacgaagaaggctatggccgatgcggcttacgagatccagaaagaggagcagcgtaagacgatcgaggtgacaaccgccaacgcggatattgcaaagcaggagcgtgagattgagctgaagcagaaagaggttgcagtcaaggagcagtctctggaggcggagatcaagaaacaggcggaagcggataagtatgcggcgcagcagcgcgcggaagcagaactttaccagcgtcagaaggacgcggaggcgagacagttcgaggcacagcgcgaggcggaggcgagaaaagcgcaggcagaggcagagcgttacgccaaggaacaggaggctgccggtatccgtgcggtcggtgaggcagaggcatctgcgatccaggccaaaggtattgcagaggcggaagcgatggagaagaaagcggaggcgtacgcaaagtacaataaagcggcagtggcagagatgatgatcaaggtacttccggacattgcagccaaagtggcagagccgctcggccagatcgacaagatcacgattatcggcggcggagaaggtggaaacggtgtggatcaggttgccggcaatgtgccggttgtcatggcaaaagtatttgagagcatgaaagaggcgaccggtattgatctggcagacatcatcaacgcagagtcctacgatgcacaggtgaaccgcaacatcaatgtgtcgggactcgattccgtgaatcttgtggtaaaagatgaaaagaaaggcgcagaacagccggatgcgcaggacggggcaacgacagagtgatgacggtggaagttggcgtcaaccgcagagcgggaacggggcagtctgttacggcggcagtttttatcgtgatagcggcgggatcgatagcggtgatcccgctgcttgccgcaaaccttgaccgtagagcactcgggcttgcggcgtgtgttctcacattagttttctgggtcgggtttatcggggcaatctgctgcgtgggggagattgtaaatacgccgaccagggcgttccttctcaccagtgactggcagttgtattatgttcattttgcagcccgcgactacggacccgcaccggtgacaaaagccggggagatcgtacataattacaaggtgctctccgaggagaaaaaaggacggaaatggcgccgggagtatctgggcagcgaggagttccgcagcatggcgcagcagtacctcgagggagtgcggacggatacgatggggtgcgtgatcgagcatcttcagacgccctctatccgttccgaaggcatcgacggaagtgtgctgcgctactgggatgacacccggaaaaagtgggcaacgatccggcttttaagaacaaataccggatatgagaaaatctgccgtacggtaaagctccgccaggagctcggacgctaagaacatctataaaaacgggactgccgcataaagcggacagtcccgtttgacgtgataagtaatataaggaggaagatcatcctatcgatttcagatggaaatgtagatggaacattcgttgaaaaaaatgcgcgcatttcttcctgccggatttttgcatcgaattccgtgtctcttccacgttttgacaatccacggaatgtgtccgacaaaccgcagacaatgagcggattccctagtgtccctagcggcactgcttcacagacaatataaaaccgcgcgaaccgaactcgccgtcatctgctattgaagttaaggcagatgacggctcaaacagcggcttcgcgcggttatgttttattcagcagtgccacaagggacacacgagaatcctaaaattgtctgcgggttgcggacacgcccgtggagtgttcaaaacttggaaaaacacggatcatcggagatgcaaaaaccggctggttagaaatgccacatttttgatccgaatttccagatgcattccatctgaaatcgaaggacatggtcattcttcatactacttaccacatcaaacaggactggctgtttgatgcgacagtcccgttttgtatggaagagaaaagattactgtgtatttttctgcagttcattggcattttcctgaagctgctgcatgatcagggcaatgtcgtccacgctttgcagattggtgcggcagccggcaagggtcgcaccagcgcttgcggtaacttcctgtgtcagggcggatacattttcgatgctctggataatctggctgttggaatcagataccgcatccacaccctgctttaactcggacatgccggaggtaatgcttgcggtatttttctcaatgagatcaaaatatccggcagcagaagtaatgtattcactctggtgcctgttgctgtcgaacagttcagtgacggagtcggtaacggaggaaatggactgcgagatgtgctcaatcaactgattgatatctcccgtagcaccattggtctgaccggcaaggctggaaatctcctcggcgacaacggcaaaaccgcgtccggcttcaccggcgcgtgctgcctcaatgctggcattgagcgctaaaaggcttgtctgggaagcaacactgctgattaaggcaacgatgctctgcattttgtcagcatattccttcagctcttccatagaatccgcgacgcgtgtactggaagcctctgagacctgtacctgctgcacaagattcttcataacatctttgcttgccgtcagattggcagaggtctctgcggtggaggagagaagttcggcagtgacggatgatacgttctgtacctgctggtcaatgttttctgtctgctgttgctgcacctggatggcagcggcggtctcggaagtgccgctggtaagatcctccatggcggtctgcgtgccggcgatggaatctcgaagctgtgaggtgctgtgtgaaacctgatcgatatttcctgccatatctccggcaacctttaaggtcagctgcagaagatcatcggactggctgcggtcagagtcagcctttttgatgttggcatcgttgatctgcgcaatctttgtgacagacatcaatacaaaaatataggaaaggataatgcaggcgattataatctcggcattggtaatctgggcagcggtgaaaccctgtgtaacggcacgaaagaccagaacaaggatattgatcaccagtgcataagtacacagcagggaaacgagctttttatctgcatacaccagaagaatcaacagcattacgattacatagcagaacgtcagatctgttgatgagataaacatcacataggcatacagaagggcaaagccgccgccgcagagatagcgcacactagaggtatccttctgctttgtgtaggcaagaatggatgtgacacagggcagcagacagagcagaagaaaaatcagatacgacggaagactgcgcacgccttttaagacttctgcgatgtaggccgccgcaagtaccgtattcattgtgcaggtgccggcaatggctgtcttattgcggctttgtgctgcaactgccggatgggaaagatcggtcaaacgattatccatagaaagaatcctcctttgtaaataccgtattactctaaatgtaaaaaaggcaccggtgcatcttgtgcaccgatgcctttttcctgttattattgtaacagtttggcggatgttcataaagtagatgtaagaggaacaggactattttaccagattttctgcataatccagagcttctacgatatttgcatggaaattttgggctccgacgtactcggtaaagccatctttgaccattacggacatcggctgttcgttgacgtgggagaaaaccagtgtaatctttttcttttttgcacggtcggccagttcgcgcagtgatttcatggcactggcgtcgatggcagggacgctgcgcatgcggatgacaatcacgcgggtagccttgtcactgttgatctgtaagatctggtctgcggcggcgaaaaacagcggaccactgatctcgaagacacggatggtgtgaggaatatcgcgcagtttttccgcttcgcccggggtaacgtccggctcatccagatatttccatgcggtcacatcggcggtttctgccatacgcttcatgaaaagcatggcggcgagcacaacgccgacttcaatcgcgatcacaagatcgaaaaatacggtgagcaggaaagttgccaccagcacaatgacatcgctttttggcgctgttttgcagagacggaaaaaggaagtccagtctgccatgttggcagccacaatcagaagaacagcggcaagcgttgtcatcgggatcaaagcggcaagcggcatgagcaccagaaggataatggttaaggtaatacagtgcacgatgccggcgaccggggtgcggccgccgttgcggacgttggctgcggtacgggcgatcgcaccggttgccgggataccgccgaaaataccggaaaaaatatttccgagtccctgaccgaccagctcggcgttggatttgtgggtatcaccgatcattccgtccgagacgacagcggacagcagggattcgatgcctgccagcagcgcgatggtaaatgccggtgagagcatttcctgcaccagtttcatggacagtgccggaacatgcggtgtcgggaaggaggaagaaagctctccgtagacactgccgatggtgttgaccgggagatccgcgaagtagacaacggcggtcgtgacaataatcgcaatcagagatcccggaatcttgtcggtgactttcggccagagcagcatgatgacaatagctgcggcgcccacagcggtggcagtccagttgatggtggaaatatttgtggcgtaggcaatgaccttatccacgaacccggacggcacggatgcgatggagagtccgaagaaatccttgagctggccgacaaacagggtcacagcgataccgcaggtaaaaccggttgtgatggtataaggaatatatttaatgagagaaccaaagtggcagattcccattacgatcagaaaaatgccggcaagaatggttgcgacagtaaggcctgccgtgccataatccgtgacaatgccatagatgatgactacaaaggctgccgtaggaccaccgatctgcacacggctgccgccgaaaaacgagataaaaaatccagcgatgatggcagtatagagcccctgctccggcccgacgccggatgcgatggcaagcgcgatcgacagtggcagggcaatgatggcaacgatgataccggagatcacgtcgcgcatggcctgttctttgctgtagtcctttaagacgtcaaatagttttggtttcaattcattcattttcatttcctcagtctgtaattattaaatttttataaacacaagtcagaattttagcactttacaaacgcgaacgcaagaacgcatgggaaaaaatacaagcacatggaaaggtgagcaaaactgggaaaaatggaagacattttacaggaaaaagaagatgtgaaaagccggattgtatgctaagatagatgataataaatgatataggaagaaaggcggcaatcatggcggagtcgggcaattcttatcagaagatctatgaaatcgtaaagcagattccaaagggatgtgtggcatcttacggacaggtggcggcgcttgcagggaatcccagatgggcaagagtggttggctacgcgcttcacgtgaacccggatcccgcgcatattccctgttaccgtgtggtgaaccgggaaggcagactttcggatgcctttgcattcggcggtgtgaatgagcagaagctgctgctggaggcagagggcgtcgaagtaactgacggctatgtggatatggaactgtatcagtggaagaagttccggatttaagagagacggaggagaaatatgcaaaaaaaggaactggcacttcaggtgatagagcgcttgaaaaaggagtatccggacacgggatgctcgctggattatgacgatgcatggaagcttctggtcagtgtgagactggcggcacagtgtaccgatgcgagagtcaatgtggtcgtgcaggatctgtaccgggaattcccggatgtggatgcacttgcggatgcagatgtggaggagattgagcgcattgtaaaaccgtgcgggctgggacatagcaaggcgcgcgacatctccgcctgcatgaagatgttgaaggaaaagtaccagggaaaggtaccggaagattttgatgcactgttagaacttccgggagtcggcagaaaaagcgccaatctggtgatgggggatgtctttggacagccggcaatcgtcaccgatacgcactgtatccgcctggtgaaccgcatcgggcttgtggacgggatcagggaaccaaagaaagtggagatggcactctggaagctgattccgccggaggagagcaatgatttctgccacaggcttgtggatcacgggcgtgcagtctgtaccgcgcggacagcaccgtactgcgaccgctgctgtctcaatgacatctgcaaaaaggccggaatttagaaaaagataaaataaatcaatatatttgattaaaaacgcaccttgcggaagcgtaaggggtatgatagtatatacgaaatgaataacagaaatcaactttcttgaattattttgtatggaggaaagatatgaatattgcagcaaaatacggaaaatcatactttatgccgccggaggtgacatatgactgggtgaagaaggacagcattgagaagccgcccatctggtgcagcgtggatctgcgggatggtaatcaggcgctgattgagccgatgggactggaggaaaagcttgaatttttccggatgctggtcgacatcggatttaaggagatcgaggtcggtttcccggcagcttcggacacggaatacaatttcatgcgtgcgttaatcgagcgcgacatgatcccgaaggatgtgacggtgcaggttttaacccaggcaagagaacatattataaggaagacatttgaggcggtcaagggagcgcctcacgcagtcattcatctgtacaattccacttcggtggcacagcgggaacaggtgtttaagaagagcaaggaagaagtcaagaagctggcagtggacggggcagaattgttaaagacactcgcggcggagacggacggcaattttacgtttgagtacagtccggaaagcttcccgggcacagaggtggactatgcggtggaggtctgcaatgcagtgctcgatgtctggaagccggatgcagagcacaaggcgatcatcaacattccgaccacggtacagattgcgatgccgcatgtatttgcctgccagatcgagtatattcacaagcatttgaaatacagggataatgtggtgttgagcgttcacccgcacaatgacagaggatgcggcatcagcgatgcggagttcggtattcttgccggtgcggatcgcgtggagggcactcttttcggaaacggagagcgcaccggaaacgttgatattgtgacgctggcgatgaatatggtgtgccacggtgtcgatccgaagcttgatttttccaatatcagcgagatccgcgagaaatacgagcgctttaccggtatgcgggtttacgagcgtacaccgtatgccggagatctggtatttaccgcattttccggttcccatcaggatgccatctccaagggtatggcgtggagagaagcgggcaagagcggcgaccgctgggatgtgccgtacctgccgctggatccgaaggatgtcggaagggaatacgagtcggatgtcatccgcatcaacagccagtccggcaagggcggagtcgcattcgtattaaagcagaacttcggtatggatctgccggataagatgaaggaagaagtcggttatctggtcaagggtgtatcggatcgcagacatcaggaactctcgccggaagcaatttaccggatttttgaagaacattatgtcaacctgtgcgatgcttttcagatttcagagtgtcatttcgagcagaaggacggcatcacatcacgcctggtgatcgagcacaacaaggagcgccgcacgattgagacgacaggaaacggccgcctggacgccgtgagcaacgcaatcaagatgtatttcggcatcagctacgagcttgccgtatacgaggagcacgccatttcagaaggatcctcctccaaggctgcggcgtatgtggagattatctgcaagggcaagaattactggggcgtcggaattgacgaggatattatcaccagctcgatcgcggcattggtatccgctgccaacaagatgttaaagagtgagaacatcgtggagggacgcgaggagcggattgttgacatcatgaattacatacagaatcactatgcggatgtgacgctggatgtgctggcagatcagtttaatctctccaaaccgtacctttccaaatacattaaggaaaagtccgggatgaccttccaggatgcggtgaagaaggcacgcatgaaaaaagcacgcaccatgttaaaggagacgaaccagaccgtagagtcgattgccgcctacgtgggttacgagaatgtggagcattttaaccggctgttcaaaaaagcgtatgagatgacgccggtgcagtttcgcagaaaatatcagtaattctcaaagaatagaatgacaactgggaacaggggaaaggtattgtggtactttttccctgttttttactgacagacagaaacaataatggtataataggagaatcttaggtaaggaggatgcatgatggaagagtttaaacagcttgaaatctacctgtttcctatagtgatgctccttgccatcggaatgaataactggaagcgggaggaacggacgcagggagaccggattttcgggtttcttccgtttctgattatctgcatgatgggcagtgatgtgacgtatcatgcactgcagctttatgtacatcggtttacggtgctgtatgccgggtatctggtgtactgcttcttcctgacagcagtaccgtatgcctggcttttgtatgtgaacggaaagctttctgtgcggcataaccggcggtggacggctgcggtatgccatgttatgacaggaaccgctattgctgtggtgctgcttacggtgatcattccctggagactgagcacggaaggatggggcgtgcatgcggtgtcctacagcttaaatcacggcagtctgccggcaaagctggtaagtattgcgatgtatctgatgggacttattctgacagcgacggcgtatccgaaggaggttaccaaggaagggcagaaagagacgcgctatctgcttgaggcaggcgtgttcagccttgtgggcggaatggtgcagagctttgcggagagctggcgcacgggaggaccttttgtggcactggcagtactgtttatttatctgaatgcgcagaaccggcagatcacgacagacgggttgaccggactgaataaccgcagggagtttgacgcacatctgcagcggaagatcgaattgtgcccggagcacgagtggggacttctgatgattgatgtggatgatttcaagcggatcaacgatgaactgggacatgcggtgggcgatgaggcgctctggcatacagcggatattctgcggggggtgttcggcaaagatccggtatttctcgcacgctatggaggggatgagtttgcggtgctcggagactggtttgggcaggaacagattgaggaagcgatcgcgcggatccaggaaggtatcgaccggtttaacaaagagggacagcttccgctgcagctgtccatgagtatcggctacgcgttctggcatgaagccggaaggcgcggggagaacctgatacagcaggcggatgagcggatgtatgaggagaaacagaaaaagaaacgtatgcgcgcatagagcgcggtgcatggggaggcggactgcgtgagtacggcagcatttttacagatcaatttcataccggcggttgcgctgcttatgatgcgccataataccaggcggacgctgtctttttcgtggaggacacgcgtgctgcgcacggagatgctgctgtttgtactgcttttactgtgccgcacagcgattttgtgcaatctcggaaaaggcggatttggtccaaggattttgttaaaggggctgggggtgtggtatgcgttcggccttttggcatgcgcctacctgtgctttttgtatgtgctggatgtggcgcaggacggaaacggacagagagggataaaatgctggattctggcgataccggcactgatcggcagtgctgtgctgctctcaaacccgtggacgaaggcggtctattttatcaatatggtgaattactataaaaagggacctgcggcatatctgatacctgccgtgggcatgttataccttgtggtggcattccttcttgctgcgtttggtgcgcgccgtgccggaagtgcgcagcgcaggggagaactggggaagcttgccgccgcgtttttgttccctgctgcgggcattctggtagaaaaaatattttccatggatgccgcatgggcgttcacggttgcagcattgctgtgggtgtatcttggtattcagaaaggtcaggtaacgcaggacggactgaccggtcttaacaacagacgcagactggatcagtatatgtgggaacttgacgagcgcagcggagagcgggagacctgctgctatctgctgatggatgtgaacaagttcaagaaagtaaacgatacctacggtcacgtgaccggcgacgaggtgctcaggctggtggcggagcagttaaagcgcacctttggcaatatgcaggcgtttctggcacgctacggcggggatgaattcgttgtgattgtaaaaggtaagacgcaggacgagatggacgtgattattcatcagacacaggagaatgtaaatgcaattgcctggggagcggataccccgtggcagctgtcgatcagtatcggctgcgcgatgcggggagagcagggaaagcaaaaaagccatgaactgctggcgcttgcggatgagcgcatgtaccgccagaaaaaaggtatacaggacagataatccgggcatactctcttcatacgttccgatgggagcagaagacggagggttagtgcaatgaaggatggagaagtgagagactttggcaggcgggataagatcggctacatgttcggtgactttggcaacgattttacctttatttttgccagctcgtttctgatggtattctataccaaggtactcggtatcagcggtggaatggtggggacactgtttctggtcgcacgatttgtggatgcattcacggatgtgacgatgggacgcatcgtcgacgcggcaccgccggcgcgggatggaaagttccgatgctggatccgcaggatgtgcggaccggtggcgctgtcgagttttttaatgtaccagactgccatggcgcaggcatctatgccgtggaagattgtctacatgtatgttacttatcttttgtggggaagtattttttatacatcgatcaacattccgtatggttcgatggcatctgcgatcacgacggaggcatcggagcggacggcattatcgacattccggtcgattggggcgacactggcggggcttgtgatcggcatcgtgacgccgctttttctgtacacgaccgatgcagacggcaatcaggtcgtgcgcggcggcggaacatttacggtggttgcgggcattttctcgattctcgcgttactctgctatctggtctgttaccgcatgactacggagcgggtggcggtggagcgtgacgtggacgcggaatctgtgagttttgcggcaacgctcggtgcgattgcgaggagccgtgcgcttctcggaatgattggagccgcggtatttctgctgctctcccagctgttaatcagcacgatgaacaattatatttatccggattacttcggggatgcccgcggcatctcgctgttcacgctgctgtccacactggtgattctgctggtggtagcgccgctcggtgtgcctgtttccagacgatttgggaaaaaggaggcgtccgtggcggggatgctgttctccggtgttgtatttgcagtcatgtatgtgctgaaattacagaatatgtggctgtttctgtggctcggggcaatcggatatctcgggcttggcttttttaatacagtgatctgggcgaatatcacggatgtcatcgatgatcaggaagtgcagaccgggcaccgggatgacggaaccgtctatgcggtatattcgtttgccagaaaggtcggacaggcgctggcaggaggcatcggaggatgggcgctgcaggtgatcgggtatgagccggctgcggcggcgcagacggatgtggtgcggcgtggattgtacaccacagcaacgctggtgcctgcgatcggattttttgttgtggcagcgattctgtggtttgtgtacccgctggataagcggcgcgtggagaaaaacgtggaggaactcaagaaaaaacatctgcccgctgagcactgactggtgcggcgggcagatgttttttctctgccggggattactcgatttcgatgacgctcaccgggcagccgtcagcggcttcctgcgtggcatcttcctgttccggcgtcggctgatgatagacctccgatacattttcatcgttcatccggaagacctccggacatacactggcacacagcccgcagctgatacagccttcgatcacatttgctttcatagggcatcctttctgtgaacctcccgggggaggtgaatgatggttacctgtttagggttgccggtgtaaacgcgtcatatacgaaaaagccgttaagaaaccgctaagaaattaagaaaaagatgattttacaaatacaagtttgatataaaaagaatatatgttacaataattagcaaatgcggaaaggatggtgggagaaatggcgaacagcaaaagacataagttggtatgctgtctgatggcgatggctctcctgctgtcttttttttatgtggtaccggatccggcaggcaaggcggagcgtggaaatgctgcagcctgcgtggcagacgggcaggctgctctgacgggagagatgaggcacgaaggttcctggcagaatatgatgtctgcacagacgctgctggaagcaagggacgcaaatccggatgcctgcacagatacgttcacgatgattcattccgtgctggatgaagtcgtcatgcgggagcaggcgggcatgcgcagcctgctgtccaaactgctggcggtggttgtgtgggtgatgcttctggtatgcgttgtctgccggattctaagccgccgttacggatgtcgcatgatttaccattgggagaatatctattatatacaccagacagatggaaagaaaggagattgctttctgaattacttacatatatagaaaaacgtaatgacaggaggcagtttcagtgaactataaaaaccaaataagtgacagagtaaagattttgctgattgatgaggatgaaagtattttttatctgatccgcagggtgctgctgcgggagaactataggctttatacttccaccagcggacgctccggcatggagatgagcaccagtatctgcccggatctgattctgatggatacccagctttccgatatggacgggattggtctgatccagtggttcagagagtggacggattgtccgattctcgttgtatccggacagacgggatatatggataaagtcaatgccctgtatgcgggagcggacgactacattgtcaagccgtttcatgagcaggagcttgcggcgagaatttacaccgcgctgcgcagaaggattccgggaggacagggaagcttttatcaggcaggagatctgaagattgatttttcaagacgacaggtaagccttgccggggaggagattcatttttcgccagtggaataccggattctggagtgtcttgccctcaattcgggaactgtggtgacgtatcagatgttgttagagaagatatggggaccgtatgcaagcagcggcagccgtattctgcgggtcaatatgacaaatatccgcaagaagatagagaagatcccgatggatccgacgtacattaccacgatcccgcgtgtgggctaccgcatgcttgagagtcagacggcatcggttgtctgagctgaggttgaagcggaagctttggatgatgaagtgcctttgccttcaaaataggaatcatagattccgtagataaaacctccgataatgataagaataccgatcacagaaaaaatgtgttcaaagattgtcatataaaatccccctttggtttcagttgtcatcaagtataacagccaggaaaacggagggggattttgccgcttttttttaattttttcatagtgtaccaggaagagacttaacacttttttagcagcgggagccaggcagaggcaatattgtatgctttttgaacaaaatggctatattttgttaaataaagtactttttcgtagaaatatatggcaatatttgtgttttttgctataataagggtaatatgttaagaaacagggagaaggttatcaatatgaaaaaggggaagaagcaggcaaagcgaagaaacgcgaatgttacgatggcatttggaatccgggagaagatcgtgctgtgttttcttgtgccggttctgtttatgattgtgcttggaattatttcctaccgcaaggcggcggacggaatgagcagttcctatcgcgattccacgcagcagacgatcgagatggcgttgcagaatatcgatacgagcaactcgttcatcagtgcagaggcattaaaatacgtggtggattcggatcttggaaagtattttgtggggatttacgacaatgatccaacgtccaagcgggcgttgattgaccaggtgaagacaagaattcttgcttcccaggtcggcaactcctatatcagcaatatctatattattccttccggcgatctgcagatgatctcgacgaagagcaaggcgcagaagggcatttaccaagagtacatggatgagatggcggctgatggcaagctgggacagtgggatgaccatcacaatgcgctggatgagtatctgagcatcgacccgtccggatacattatggtatatcaggcaaccgcgcagaacggtaaggcggttatcgtaatcgacatcaaggcggaggcagtcacagagttcatgcagggactgaatctgggagacggaagcattgtgggattcgtgactgcaggcggcagagagcttgcagtgaagcgcaatgcgggagacgaacagggaacgccggtcgagggagagacgatttttgcagacaaggatttttatctgcaggcgagtgagacggacggcgtaagccaggtgcagtacaacggaacagagtatctgtttttccacagcaagagtgaggataccggggcaacgatgtgtgcactggtgccgttaaaggtcattaccggacaggcagagtccattaagcagatcacgatagcgggagttctgatctccagtatcattgcacttttgatcggaaccgcagtgacaagcggaatccgcaagaatatgaagcgtatttccggaagccttgaggttgtggcggaaggtaatctggcaacgaccgtgtccgtgaagggacgcgacgagttccgcggacttgctgctgcggcaaatgacatgatcgcacacaacaagcagctggtgcagaaggtcagccaggcgacggataagctggcggcatctgccggtgaagtgacgaatgcatccggtattattcaggagtattcgcaggatatagcaaacgcgatcggtgagatcaacgagggcatggagcggcagtccacacatgcgcaggagtgcgtgagcaagacgggaacgctttccgaggagattcaggaagtcaaccgtgtggcgcgcgaggtagagacgcttgtgtctgaggcggaggagatgatccgcaaaggtatggaccggatcgaacagctgggacagcgcgcgaatgagacgacagctgtgaccgcgaaggtggaagaaagcatcgaagacttgaagcgcgaatcggagacgatcaatcagtttgtttctgtcattacagatatttcggagcagacgaacctgttatcgctcaatgcatcgattgaggcggcaagagccggagaggcaggacgcggatttgcggttgtagccgaggagatccgtaagcttgcagacaattcggcggaggctgccggagagatccgcaataatgtggagaatatcagtgcgcagaccggcgtgagcgtcgagagcgcaaagcaggcgggcgagatggttgcacagcagaccgaagcagtgcgtgaggttatcggtgtattccaggatatgagcgatgccatggataagctgtttgacggattaaaggagattcttgccggaacggagcgtgccgataaggagcgcgaggatacgcttgaggcagtacataatatttcttctatcattgaggagacggcagcaagcgccgaagtggtgaagaaggttgccgcaagtctggagcagaatgtagagaacttaaacggcacggcggagagcctgggagataatatgacaggtcttaagaccgagatcgccgtatttaagacagaataggcgaagaacatttagagaatataatagaagataaaaaagcggcagccagtcgatcatgagatcggctggctgccgcttcttgaacgcagagagaactgcattttataaagcaaaatttgcaggggtcacactgcatcagaacgcgcaatcagaggttcaggcaggaaagattaagcagaaactgccggtgcagcagctctctggagagtatagcagactgaaaggagtcaagcgcaagctgatagacattcgcatactgtacatagtgccagtgaagttccgtctgccagttgtcgagtgtgatcaggcggtcttcatccagatgaaaatcaaacagatggctgcgcagctcgtaaagggcggcatagcggaacaggttggcgagcatatggcatgccttatctgtgtcagtgatggcaggcagacgcacgctgccatagcgcttaagccctgcaaaccgggagccggttccggaaaggttctgggcgatctcggtctcgagaagtgtgccaaaatcggtgttgtagtagtttaaggtggcagcgaccagggtatccgtcaactggacaaaggacggatggtgcagacagtcatgctgctcaaaatactcgtccataaagtcatagagaacaaaagactcgcagctgaagtgatattccggacggtatgcatttaaaaactgcggcagcaaaacagccagtgcgtccgtgtgatgcatcaggcacaggcagagtgctgcgtagaagttccggcagtccacgagcagggcatccagcggcagattgccgtctgcgtaaggcaggctggcagcctctggcgcatgatcttctatcagagagttgataactggtgtggtggtgccgaaaggaacccctgcagtcagcacaatggcggcatacagataaaacggttcaaagccgtccgctgcgatggaaggcgagaaatagtcgtctgcagagagataatcctccagtgtctcaaagctgtcctcggccgacgggcaggaaacctgatctgcgaggaattgtgcgagatccggatgctcttctgacacgcaggatagaaaacgaaagagcgagtaggtgagaacacgctgtctgccggcaggctccttcgtgtagtttacaagaaatgcggggggaaataattgatcgttataagtttccatgaagaactccttttccaaaagtaatccgtatgtgtgtgcggacggatgcccgcagcgcataccgacatcatagcacattttagaattagatgccatcatgcgttttcattttccgtcaggtgtgttacaataacaagcagacatagaaagcagacagagggaaaaagatgccaaaacagaatcaaccaaaggaagagaaaagagaaaaggggacagcacaagcggtcatccgtgagattttaagctgggtgataccgtttgtaatcgcgcttgccgttgcgatgtttttgaaaaattatattatcatcaatgccgatgtgccgaccgggtcgatggagaacaccatcatgccgggggatcgtctgatcggaaaccgtctggcataccggagcaagtcgccggagcgcggtgatattgtcattttccgttatccggacaacgaggaagaactgtatgtgaagcgtgtgatcgggcttccgggcgagaccgtggatatccgggacggatacatttatattgacggagcggatacgccgctggacgaggattatctcaaagaggactggacggtggcgacggggaattatcattttgaggtgccggaagactcttatctgatgctgggggataatcggaatgattcgtgggacgcacgatactggacgaatccgtatgtgagagaggataagattctgggcaaggcggcagtgatctactggccggtgcatgatattggaaagcttgagtaggggagaagcgatcgagggggtagttttatggttacattattggcgaagatattcattcaggagaagaacgatcaggcgaagattcgtgaagaatatggtgtgctgtgcggtgtggtaggtattctgttcaatgtactgctctttgcgggaaaatttcttgcgggtaccatcagccattccattgccatcacggcagatgcggtcaacaacctgtcggatgcgggatcttcgatcgtgacgctggcgggcttcaagctggcaggcacaaagccggacccggagcatccgttcggacatggcaggattgagtatatctcggggctggtggtggcagcagcgattcttctgatggcatatgaattgatccgggattcggtgggcaaaatcgtacatccggaggagacagagttctccggactgattgttgtgattctggtgttgtcgattctggtgaagctgtatatgtatttttacaatcacatgatcgggaaaaagcttgattccgcggcaatgcaggcaacagcgatcgacagcctgagtgatacctgcgcgacaacggcagttcttgcggcaacactgatcggacattttacaggacttcacatcgacggatggtgcggtgtgctggttggtgtattcatcctgtatgcggggatcagcgcggcgaaggagacactcaatccgctgttgggacagccgccggcagaggattttgtcatgcagatcgaccggattgtcatgtcgcatccggagatctgcgggatccatgatctgatcgtgcacgattacggtccggggcgcaagatggtgacgctgcatgcggaagtgccggcagacggcgatattctggaagtacatgatgtgattgacaacgtggagaatgaactgcgggagaagctggggtgtgaggcgacgatacatatggacccgattgtgacctccgatgagcacgtcagtgaactgaaagccgctgtcgtatcgatcacaaagggaatagatgatgtgattacgatccatgattttagggtagtcagcggtccgacccattccaacctgatcttcgatgtgctggtgccgttccagttcaagatgagcgatgaggaactggttgcggcgatctgcggaagagtcacggaatgcctgggggataattactacccgaagattaaggttgatcatgcctatgtaaaataaaacgaagaagattgcggatgtaaaggaattgccgcaataagcagagtcctctttggagtgataagtaatattatgagaagcatgcccctgcgatttctggtggaatgcctatggaacattctgttcaaaaaatgcggcatttctaaccagccggtgactgcatctgcgatgatccgtgtctttccaagtttggagcactctacggactgtgtccgcaagccaacagacaattttaggacttttgtgtgtcccttatggcaccaatgaacaaaacataaccgcgcgaagccgatgtctaaattggcatctgccctattttcaatagcagatgccaacgagtttcggttcgcgcggttttatattgtctgtgaagcggtgccattagggacactagaaagtccgctcattgtctgtggcttgtcggacacactccgagagagtccaaacgtggaagagacacggaatcagatgcagtcatccggctggaagaaatacacacatttttctccaacgaatgtttcatatgcagttccacccgaaatctgcatcatgcgcttcctgtaatattacttatcaaagtaaagtacggtatgcttattacggcagttccttttagcatctagttgttggaatctgatgcagcttcggaagtgacggctgagctgtcggctttggaggtcgtttcggagctgcctgtctcagagctttctgtttctgtgttcttcatctcggaactttcggtctcagagcttttcatttcagagttttctgtttctgtgttcttcatctcggtagcggacgtctccggaatctcggtcggatcttctgtctccggaacaatatccggatcttcgtagataacctcgccggtaccggcacggagcagtaggctcttggaaccgaggatattcacggtaatggtatcgccgttctgcacattgtccaggctggtcgtaatcaggttcgatgtcaggaacgtggtaggaaccttattgccgtttacaaaaatcttcgtattcttggtaaagttcgcaccgtacaccgtcaaggtattgttgcttgtattcttgcggacagaggagacggtaacgtcctccacatccatcacaaggtcggatgcagggtagcggtcctctccgccgtaggtgtagcgtttgccgtacagcagatcgtactgcagatcctccagaccggaaagataggtctcggaagcggtctgtgtctgatgataacggaacatggttccctcatgaatacctgcctgatcggtaatgtgagcgagaagctggtaagcggtcagatcagcatctttttttgcaagccccatgttgttccaggtgatgtacttggtcttgaaaatatcaccggacttcatatccgcatcggtgagtcccatcgttggaagatgatcgccgaagaacacgatgatggtgtcctctccgcggcggtcaaccgctgtgatcagatctccgatgaagtcatccacttcatgaatcatgttgacataatattcccactggttgttggaagcctcatctgcggcgccggaaacaagaatatccggattttccagaatcttctcggtcgggtaatcgccgtgaccttccacggtaatggtatatacgaaatcggactggttttccgtcgcgttcatagcttttacagtctcctgtaccagcacatcatcagtcggccagttgccattcggcgtgtactgggagatgttcatgcactccttgctggtaaaggtatcgaatcccatcatggaaaaagcattgttgcggctgtagaaagtagcggtattgttatgtacgacatgcgtaccataaccgatctgggagagatcatcggcaatactttcgcagtccgtctgttttaagatcgtcttgtaaggatactcaccggtaccgaaatactgcatgctcattccggtcagaacctcgaactccgtattggcggtacctgcacccacgaccggtacggtaaggtaaccggtggaatagtttgcctcaaggttgtggaaattcggaatcggatcttcggacatatttaaaaagtttacttcgtaaggatcacagaaggactccagtaaaacacagataacatttggctcgctgcctgtggaaacagtggtcgggctgctggcggaatcaacaagggtgttgatcgcatcaacggtttcctcggaataatcctccggtttatccatgcctcttccgacaacactggtggaaaaaccgtacacaaaaccgtaatcagagtagccctgcgcaatatttgcaaaataggaagcaagaatgttggaactctgtgctgcctgtgtggtaatcggaagaccgattaaaatcagagcggcaatggagaccggaccaagcacggtatggcgttttccctgataacggggtccctttgcaaagagaagaccaagaatgacaaagaaggcaaccacaacggacacgaccatggttgcttcctccgctgtaaaatagttggtgttctgcattgcgaacagatccggcagacattttaagtctgtgtagctgaacggtgtgacacggtttgacagaatcagaccgttgacggttccaaggaaaatccacaaaccgctgattaagatacgcatctgtgtacgatattttgtcagatagacaagggatagagatgcaaagataatcagcgcattatataagaatgcaagcgtgtgattgctgatgaaagttatagcgctcacaaagtcccgtctggaaatcgtctccacggcaagaattaacagacaggctaataaaaagtggaaaataagagaatacttattaaggaaagcaatccgtttatagtatttttcactgtgtggcttcttctgcggaagaatgctcttcagagattgaagcttactggaaagcggtgcaagcttttcttttagaatgttaaataattttttcatagaaccctcccaaaatgactgtaggcggtgtgaaacaccgatacgctcacgcgtgcaatatatgtgggcagccgggctgccgattctccagtgtaaaactcctgtaaaaaggaagtaaagctaaatttcgatactaagagaatatagcgctaattgcatcaaaaatcaatcgggaagatgaataaaaaaggtttaagatttcctggatttctataaaatatgaataaaaaatgaacaaactatgtccaaatgaaaaatgtatcactttacaaacttgtcgatcgcgtcatttaagtcccggatgacctgctcatccccggtttcaacggcgtcgaccaggcagtggctgatgtgatcctctaaaatgattttaccgatattgttgatggcggaacgcaccgccgcaatctgaacaagcacttcgctgcagtccctgtcgtcttcgatcatcgtgcggacggcctccatatgtccgatcgcacggttcatgcggtttaagaccgccttggtattctcgtggtgatgcggatgtgtgtgagtggagccgtgggcatgagtatgaacggagccgctggcatgagtatgaacggtgtcgtcagcatgcgtgtgagtggtgccgtcggtgtgtgtatgagtggtgccgtcaacgtgcgtatgagtgatgccgtcggcgtgtatatgtgtatttgctgtggaagtcttctgtgttttcatgggattcctccgattcgttgcatttcattcagtgtatcatattctcccgaaaaaaaacaggttgtcttttttgtacaatgcttatataataaggaaagaatttggcagacaagggggtatatcggggatataccccttattttacgcgaaaagcgcaaaggaaggaatagaaaaaggatgaatttactcgacatcataggacctgtgatggtaggaccgtcaagttcacatacagcgggagctgtgaagatcggcagagtcagcagaaagcttttagcggaggaggttgcggacgcaaaaatatattttcatggctcttttctggcaacgggcaagggacacggtacggataaggcgatcctggcaggactgctcgggatgcaggtggatgatccgagaatcccggagagctttacgatggcaaaggagtctgggatgagttttacactggaggggattgatcttggagatgtacatcccaactcggtcaagatgaatctgaccggaaaatccggccgtacgctggaagtcattgcggcgtcggtaggaggcggacagatccggatctgcgagctggacgggctgacagcgaatttcagcggggattatccgaccctgatcgtgcacaacatcgaccagccagggcatgtggctgaggtgacttcgatgctggcgcacaagtcggtaaatattgctacgatgcagctttaccgcgagagccggggcaccagggcggtcatggtcatcgagtgcgacagagaggtgccgggagaggcaatcgagtggctggagcatctggagggaattttaaaggttacctacttaagcatgctggaagcatagatacatcagatgggcagaaagatgcagcgtatgtgacgggaaggcggtgtgaaccgtctggatgatagaaaaacagagggaggatgacaatgtaccgatcattggaggaactgtgccggatggagagagagaccgggaagcctttttggaaaattgtgcaggaggatgactgcgtggagcagggcatcagcgcagaggagtcgtttgcacagatgcgcgggatgtaccaggcaatgcagtatgcagatgcacattacgatgagacgttaaagtcagcaagtggactggtcggaacagagggaaccaggatgaagcgggcgcgggaggcgggaacgctgctctgcggagactttatcggaaaagtgatggaaaaagcgctgaagaccagcgagtccaatgcctgcatgaagcggatcgtggcggcaccgaccgcaggctcctgcggtgtggtaccggcagtgtttttgagtgtgcaggaggagcgcggtttttctgaggagtgtatggtggaagccctgtacgtggcagccggaatcggcggcgtgattgcaaaccgggcgtttttggcaggcgcggcaggcggctgtcaggcggagattggttcggcttccgcgatggcggcaggtggtgtgacgtatcttctgggcggcggtgcagatgagattgccaatgcagcggcgctggcgcttaagaatctgcttggactggcatgcgatccggtggcgggacttgtagaagttccgtgtgtgaagcgcaatgtcatgggagccgtgaatgccatgacttctgcagatatgacgatggcggggatcttcagtaagattccgccggatgaagtgattgacgcgatgcgcagtatcgggcgcagcatgaatgaggatatccgtgagaccggaaaaggagggcttgcggggacgccgaccggggtagagatccgcgaccggatggctggaaccctgtagacaaccggttagtgccggaggacggctgacagatgggaagtggaatggtaacaggattgacaggatctgaaggggaagaatcatcctgttccagaatggaagcaggcgtggagaatcgttggagcaaaatacgtgaatttcttgcatgccgcttttgacattatattccgtgtctttgccacgtttggacaatccacaggaggtgtccggcaaaccgcagacaatgggcggactttctggtgtccctaagggcaccgcttcacagacaatataaaaccgcgcgaaccgaaactcgttggcatctgctattgaaaataaggcagatgccaattcaaacatcggcttcgcgcggttatgttctgttcagcggtgcccgtaagggacacacacaaaagtcctaaaattgtctgcaggttgcgaacaccttctgcggagtgttccaaacttggaaagacatggatcatcgaagatgtcaaaagcggcatgcttagaaattccgtatttggcgattggattctccacgcctgctttcatctggaacatggctgttcttctggcctcagatagtgaaactatatgcaacattccacgtcccgtccgtcagtcgtcctccggtactagcggttgcttcttctccagatgtgcatctgctccgcctctttgatgaggtcgtcgcggaaatcgggatgcgcgatcgagatcagagcctcggctctctgccaggtagacagaccctttaagttcaccttgccgtattcggttacaacatagtgtgtattcggtcttgcgtcggtaacgatggaaccgtttgccagcgtcgggcggatacgggactgcacctgaccgtccttggtcttgaaggtagaggataagcagataaagctcttgccgcccttggacagataagctccgagcacgaagtcaagctgtccgcctgcgccgctgatctgcttgatgcctgcagactctgcatttacctgaccatagagatcaatatccacggcattgttgatggaaataaagttatccagtgcggagatcgagcggatgtcgttcgtgtagtcgaccggagcgctcatcagttccgggttgtcgtccagataatcgtacattttcttggtgccggcgccgaaagcgtaggtctggcggtaacggtcgatattctttttggaaccgttgatcttacctgcctttgcaatatcgacaaatgcatccacgtacatctcagtgtgaacgccgagatccttcaagtcggactctgcaatcagggaaccgacagcgtttggcatgccgccgataccgagctgtaagcaggcaccgttcggaatctcatcgacgatcagctttgcgacagccttatccacatctgtagcaggaccgcctgcacccagttcaccgattggcgggttggagccttccacgatgtaggtgacatcggaaatgtggatgccacactcggtaccgccgaggcagcgtggcatattttcattgacttctacgatgatgtgctttgcgcgctcgcacattgcacccagatgtgaggcactcggaccgaagttaaagtagccgtgcgcatccatcggagcaacctggaacatggcaacgtcatccgggcagtcaagctcgcggtagtagcgcggcagctcggagtagcggatcggacagtagtaagccacgcctctgtttatcatcttgcgctcgataccggacatatgccaggagttccagcagaaatgctcacctgcatcctcacgtgcaaaaacagccagcggcttcatcaggataccgccgcgcagcttgacgtctgtcagttcgtcggtgcgctttgcgagagcctgatccagtgcgtcaacggtgttggtgcaccagccgtaatctacccagtctccggatttgatgagctttaccgcctcatctgcggagacaagcttctgtttgtattcttcacgaaaatccatctcaaatacctcccacacaaaagattgttaaaattttaccatagtttcatcctatcactttatgtcgtattttacaagccctgccggagcgtatttccggagatttgtaagatcaggtctcctccggcatccgccagtctctggaagcctcccggtatttgtcgagcatcatttcgtactggatggtaagcgctgtgtcggaaggaattttggcttcctccccggcgaggagcgtctcgtaacattcgacaagaccgagcagcggaagatccccgcttgtgtgaacgtccaggatgctttccgtctcataggcggcattgtagaaccagagaaccgcttccgcgtagtcgcgctgtcccacaaaataggttcccagttcgtagcagatttctgcgcacggtgtggtgagcatgtccttcatggtcagcttgaaaaattcgttcttgttatcctccatgcggtaaatccgggcgaggacgcatgcagcttcctttcgggcgtcatctgccgggtcattgtcgaaaatgagctggaagatcggttttgcatcggtaaaatcctttttgtcgccagtctttagaagttctttggcatacatggtacggattttcggggaaaattgtccgtcgtgttcaaacgctttgatgaagatggagaagtcgcgcttgctgtgcagggactgcggacagtgcagaatctccacatcgctgtcaaaagtgaccggcgttaagcggacggtctcgtgaattggatcgatccaggtaaacgtgcgcagtctgcggaacagctttggacggtattccttttttgcattcaaaacggtatcgaatgtgccctgcgtcacatacttcatctgtacaatctcgatctcaggcagaagggcatctttaagacggagaaaacgctcgcggtttgcgtcgtcaagaatttcatcggcgtcggcggtgtagatatattccatcgttgctttggaaaaggaaaaattgcgcgcggcggaaaagtcgctggtccatttgaaatcgtagatccgcgaggtgtactgtgcggcaatttctttcgtgttgtcggtggagccggtgtctacaatgatgatctcgtccatgagatcggcgatgctgtccagacagcgcgccagcactgcggactcattttttacaatcatacataaactgatagttgccatagtttctcctttgtgggaggcagtgatatgccgctgccccgtgcgtgataacttctatcctaagtataacgcagcgggggatggcaggcaaacaggaaaataaattgtcgtggcaagatggaaggttctgtgctaaaatgagcggtggttatgtctgcagggcggacggaagacagatggaaacggagtatacagataaatgagacaaaaagaacaatttatgcagaagacgatcgtcgtgtggcagcccgggaaatgttgcagtcttcgggtttatgaatccggtgtgtggtgtgatcctgtccgcagttctgctcggtgagacggacagcttaagtgtgatgccggtggctgcgctggtgctggtatgcatgggaatttacattgtaaaccgaccggaaaagacagaataaaaaaggaggaacctatgagcgcgattgttacattaaaaaaaggtgagggaagaaccatcaaagccggaggaatgtgggtgttcgacaatgagattgacacggtgaccggaacatttgagaacggcgaagtggtgctggtacacgattttgacggttatccgatgggaagaggttttatcaacgtcaattccaagatccgggtccggatgctgacaagaaagatcgatcaggaaatagaccgcgcatttttgcagatgcgtgtgcagaatgcatgggattaccgcaagacgacggtggacacctcctcctgccgcgtgattttcggggaggcggatttcctgccgggactggttgtagataaatatgaggacgtgctggtcgtggagtgcctggcgcttggaatggagcagttcaaggagacgatcgtggaacttttaaaggagactctggtgaaggatggcatctgcatccgtggcgtttacgagagaagcgatgcgaacgagcgcacgaaggaaggcttgccgaaggtaaagggatttatcggcggggagttcgacacgaacgtggagattgtggagaatggcgttcattatatggtggacatcgtgaacggacagaagaccggatttttcctggatcagaagtacaaccgccttgccatgcagcggatctgtaaggggaaaaaggttctggactgttttacacacatgggaacgtttgccttaaatgcaggaattgcgggcgccgcagaggtcacgggacttgatatttccgagtatgcggtggagcaggcgcgggagaatgcgcgtcggaacgggctggaggacacggtgcagttccgctgtgccaatgtgctggatgaactgccgaagctggcacagagcggcgagcagtacgacgtcgtgattcttgatccgccggcattcacgaagtcgcgtcaggcgacgaaaaatgcaattaaaggttaccgtgagattaacatgaaaggcctaaagcttgtgaaggacggcggctatcttgccacctgttcgtgttcacactttatgacacaggagcttttggagaagaccgtgaaagaagcagcaaaggcgacgcacaggagactccggcaggtagaattcagaacgcaggcaccggatcatccgattctctgggcaaattcggcgaatgtgccagagagctattatctgaagttttttatcttccaggtggtagacgaacgctaagcgttcgtgatgaaaagtaagcggctgaaagtggcggaaatgcttgatttacaaggggtggaaggtgtttagtgcttagcttgcaaacctcgtaaaatatcgcaaaatatcgtatcacagtggtataaagtggtaagaaaagtggtaagtctgagtggtaagcacctaaaatgtaatgagtggtaactatgaaatgataatgatatcggagaaggttatacgttcgctcttcataatacggaaatttctagtatagatgtagcgttttgtggtatactatagaagaacaaatacctttctgcgaaagggaaaggagaaaggatacgcgtatgacagttgatagaagagtaagcagtattgaatccagtttcaaaatggaaggcatgccatttgatgcagaatgtcgtcaaagagtaagaaatgtcttggtcaagaaggtttctgcggcagatgcaatttcagaattaaataagaaatacagagtatccaagaagcaggttgaaggatcaagagtatgattatttctatgatgatgaacaggatgctaagtactgttatccgggcacaaatgtattaaagaataaactggatataaaagatttagatacattgcacgaggctgaaagagactattcggcagtacgtcaggcagaacttgtaggtcaaggcgttaccggggatttctcttttaagcatctttgctctatacataagcatttattcagtgatgtatattcttgggcgggcaagacgagaacggttgatatttccaaaggaaccgttttctgtttggtgcagtttatcgaaagccagtttgatgatttgtattgtaagctgaaaaaggaaaatttcttagctgacataaccgataaggaagaaatgagcgagagactagcctattatctgggtgagattaatatgatccatccgtttagagatggtaatgtaacattgggacaccagctaaaagtcgcataacagcaacaaacgactttttacaatctttacaataaaattgaataacatatagattagagaatacctataaaacggtattctttttttgttaaaagacgttcaaaattgagcgtctatttttttacccaaaaacaaaatgaaaggagcatttagaattatgaaaaagatattaaaacgattgtgtacgggcttccttgcctttgcgactgtcgttactgctttaccgagtacggcagtttatgcgtctgatacacagtattggacggaaagtgatgagcgtgtcggtatcgttgaaaaagtaatgaatgacgcttcgattggttctacattcaatgagggacacatgaaagttgagggcgaggacgcttattgtattgacatcaacaccgattttaaaaatcgatataagaccagagctgacgctagttcacgtatgagtgccgaccagatagccgacgttgcgttatctattgaatatgtgaagcagtacgcaaacacaaggacattgaggacgacagacagacggtgcttatcacagagcgtatcatcaaaattcatacgacggctacggacaaagacggcaaaaaagagattgaagctggaaaagatgtaactatcgttgatacggtcaagttagagggcttagaagtcggcacgaagtatcagcttgtgggctggcagatgttaaaagaagaaaatgccgagctaatcatcaatgataaacgtgttgagaatgattacatctttacggctgacagcgaaactatggaagtgaaaatcgagtttacttttgacgcttccactcttggcggtaaacaacttgtaacttttgaggaattatacgatttaagtaatccagataaacctatcaaagttactgaacataaggacattgaggacgacggacagacggttattattaaagaagtaccagaaacgcctaccccagaagaaccagagaagccagtcacaccagatacaccaacaaaaacagacagtcccaaaacgggcgacaatacaaatatccttgcctttgcgattatgatgtttgtttctgctggcggtttagctggtacatacttcttcaaacgccgtaagatgaaaaaatcataaggcggtaacgatatgaagaaagaaaaatcacgttctccgccgtagcttagataggcagactatatcttattctggcttgtctaccgacaacctgcaagaacacggatagtcaagggtgcgttagcatttatttaccctttactatctgggggattgctggtatctcattaactgccagaataaacaacaatcaaattcaaggaaagaaacgaggtaaaacactatggaattaaaatatatcgtgccgaacgtggcacagacttttggaaacttggaatttgctggggaaaataaagtagaacagcaacgtatcaacggacgctacactcccgtatcaagaagctacaacttgtattcggatattcaaagagccgacgatattatcgttgtgcttcctgcaaaggctggcgagaaaaactttaaaccagaacagcgtgtcaaacttatcaatccaaagattaccgcagagggctacaacgtcaagggacgtggatttacaaactacattttaatggctgatgatatgttaccagcagaaagtaaataagggggtattcgattatgagattagcaaatggaattgtattagataacgagaaaacttttggagtattgaaattctctgcacttcgacatgaggtgcgtgtagagaatgaggacgggacgacaagcgaggaaatcaagcgtcgtacctatgatttgaaatgtagcgtgcaggaacgcatgatacaagtatcaatctctgctgatgttcccgtaaaggattttccttacaatgcagaagtcgagcttgtcaatcccgtagctgatacggtggcaaatgccaactttagagggactacgattgattggtacatcaaggcagatgatattgttttgaagaacaaaggcggtcaagctggcaatccacagaacaatgctccgcagggacagcagaaaaagtaagctggtaaactagattttcattgtagcgattatatgaaattgttataatgtgaatatgttaaaagtacgatttatagtcaagaatatttgaatattttgcaaaaaaacacgattgcaactgtcagttgacatatttccattcctaaatggtggctgtgcaactgccaatattgctacaataaccatgaagaaaggagtgctgaaaatgaatatgtcagacagaatacaatatttaagaaaaacaaaaggaatatcacaagaggaacttgctgataaggttggtgtttcaagacaagctgtttctaaatgggaaagtgagcaaagtacaccagatttagaaaaagtaattataatgagcgacttttttggagtaactactgattacattctaaaaggcattgagccagttactgataaggaacaaaaaagtaaagagattgcaagcaaaatactttatatctcatcaacagcttttgttgctattgggttactctgtgcttttggtgggtggtatgaattacaaacaatggaagctgttgcaggttcaatgattattcaagcggtaggaattgttgggtattttattgcaagaatattatcagaagaaaaagcaacattttatgtaagttggtttaatataattgggattgcttttatgcctatttctatgattacgggatatatttctatccttgttttcaaacaaggctgggtagcaccttatccaaatggaatatttcatactttaactttcatattactattcttcgtggttttagttgcaagttatgctattctaaaaaagcgagcaaaataaatttatgttcattaagcggttagtcattatgattgaccgctttttccatacccagaaaggagtgattgatttatgagaatgatgttaaatagaggacaccgtatcagagccagcgacaagacacttgtttaccgcttctgtgcaggtacgcttctgtttctgttcttagcggtactattgcttttgaacatgggacagctcatgcgtaccgattgggagcatttcagcttattgaagaacggcttgacgcttttcccttacaacttcataaccatactgatagcgacgggtatatgtgtacttgtcgcttttctgtattaccgcttctgctatgacagtttcaagaagctgttgcaccgtcaaaagctggcacgcatagccaatacgtacttatgtactggcgtacacgagcagaactgtctggcatagaaagcaatatcagcaggcgagccattaacaatgaataaagctacagaataagggaaggactgccggatgtggtatttcacagtcttcgtcatacgagtatacttgtctgaggagtttcatcagctggcagtccagaagaaagactcataatcttcttcataaaatgtgctccctttcattcatacaacgtaaaagactaacgaacatatttaatgaaacatcgaaaccatcttctttttgttgtttacctataataacgattggagtagtcgattatagacactgcaatcaaaaaaatctgaaaatatatttatcaacattacataaaagtgtgtagatgcacataaaatgggaatatatattgaaattcaggtcgttctgtgatagaatcttattactaaaaagtgtgcagatgcacggaaatggggagtgtaacgatggagattaaaagagacgcttacctacagcagctgatcaagcgaaaagataatggaatgataaaggtgattaccggcattcgtagatgtggcaaatcctttttgctgtttaccatctttaagagatacttactggagaacggtgttgatgttgatcatattattgagattgcattggacggtattgaaaatgaggaactaagagatcctaaggtgtgtttcaagtacatcaaagatgccatgaaagacgatggcaaatactatctgcttcttgatgaagtgcagtttatgtcacaatttgaggaagtgctgaacagcctgctccgcatgagcaatattgatgtgtatgtcaccggaagtaattccaagttcctgtccagcgacattgtgaccgaattccgtggcagaggtgatgagattagaatctaccctctctcctttgcagagttttattctgtctatgacggcgattatgatgatgcatgggatgactacatgatctacggaggattgccgcagatcgtaagtttccagagcgaacgacagaaagcggactatctgaagaacatctttgcaaatgtctatctgaaggatgttattgaaagaaataagattcagaacgtggatgagattgggattctggttgatgtgcttgcatctgcaattggcgcaccgaccaacccttcaaagattgccaatatctttgccagtgagcgccagatgacttatgctaataaaaccatctccaagcatatcgactatttgacagatgcctttttgatttccaaggcaagccgatacgatattaagggcagaaagtatatcggtgcaaatctgaaatactactttacggatctgggactgagaaatgcacgtctgaatttcagacaacaggagcctactcatatcatggagaacattgtttataacgagctgttgatccgtggctataatgttgatgtgggtgtcgtggatatcttcgataaggataaagagggcaaacgtgttcgcaagcagttggaggttgactttgtggtgaatcaaggaaaccagagatactatatccaggttgcatatgacatgacttcggaagaaaaacagacgcaggagttcaattctctgcgtaatatcccggactctttcaagaagatcgtcattgtaaatggcagcaaaaagccttggagaaatgatgaaggttttgtcatcatgggaatgaagtatttcttgctgaatgcgaatagtctggaattttaagtcgatttgagttgttgctgtggtgttgttctatttcaaaaaagagtgaaatgatataaataaggccagccgatgtggtagcatttatgtgggagtacatgaaagtaccggaggattcaagagaaaaagttaagaatctgcttaaagatgcaaatgaaaatggagtaaagataagtcatcaggcaccaacactgtatgatgttgttccgaaagaagaaattgctgaatttgaagaacttatgcgcaaaaccatagctgacattgtatcagaagccagtagcgttgcctgttgggtgtatgtgcagaaatatgtgaagcacaaaaccctaaacgaaatgctgcaagaattgccagacgtaagtcaattcatcctagctatggatacctggtttgaaaaactgatggttatcgaagctatcattgaagcagataatgaaatgcagagaataaaagacaaaattggtatgttacacgaaatttagggagaaaactgagcaagtaggaaggtggaatatatatgaaacaagatactttagagggcaaagcaaaaacaaaaaatggggtaaaacggctgtgtttttccataatctgcattcttctggaagtgatttttattattactatcgtaacacgcttgaatgaatatgcagaaatcataaatttatttacaaggattttgagtggaatcttggttttgggattgtacgcatcaaataagacatcctctatgaaaatgccttgggtcatcttaattctaattttcccaattatgggtgtaggcctgtatttgttgattggtttgaatggtggcacacataaaatgcgtgagcgatatgcagaaattgatagcaaattgttaccaatgcttccggacagtcaggagtgtttgagcagaataaaagaaacaattccgaaagcaggaaatatagcaagttacatacaaagaaattcgcagtatccaatctatcagaatacggatattgtgtattttgatgaagcagtgaaaggattagaggcacagcttaaggatttggagaaagcacagaagtttatctttatggaatatcatgcgatagaagacgctgaagcatggcataagattcaagatgttctggaagagcgagtaaaagcaggtgtggaagttagagtattctacgatgatatgggttctataggctttattaacacagattttgtgaaaaagatggaggcaataggaattcattgccgtgtattcaatccgtttatgccaggtttaaatctgtttttgaacaatcgtgatcatagaaaaataacagttattgatggaaaagtcggatttacaggtggatataacctagcaaacgaatattttaattacacacacccgtatggacagtggaaagatacaggtattcgtttagaaggagatgctgttcagtcgcttacggtgacatttttggaaatgtggaatgcagtaagtgataaggatgctaatgattctgattttagtaaataccttttccactatgattatgcggcacagcaaactgggtttgttcaaccttatgcagacagcccgatggataatgagcaagtaggagaagaagtttatatcagtatgataaataaagctgaaaaatattgttggtttatgactccatatctaatcataacagatgaaatgacgcatgcgttatgtctggctgctaagcgaggggtagacgtaagaattatcacacctggtatccctgataaaaaattcatttataatataactcgttctttttatcatggattagttaaacatggtgttcgtgtttatgagtggactcctggtttctgtcatgcaaaaatgagtgtggcagatgactgtatggcaacttgtggaacaattaatctggattatcgaagtttatatcaccattttgaaaacggctgttttatggcagattgtcaggcagttgtggaaataaaaaatgatctgataagaacgatgggagaatgtcgtgatgtgacagaccaatatcaaaccggacgaagtgcatatttgcgactgggacaattatttatgagattatttgctggattgctataagaatctgatggaacgacctttcaaaaaacagttgatttagaagttaactgtttttgaaaggccgtttttgctatatctaacagtctgttgtacaaagaagattttgcatggatgaaaaaacaaaccttgttgaggttaaattgagttttccattgtattgtattgctaatgaataagaataagaaaaagaacagacaatgctgaatgctctggaaacaagaatatctgagtatagtatgtaagttcgtaacagaatgaaaggagcgattcaaatgagcaatttggaaaattatatgaaacagcaagcaattttttgtgaacaaaatgatagcattagtaagaatctgtattcagagtatggtgtaaaaagaggcttacgagatgaaaaaggccaaggtgtgttgacggggcttacaaatatttctgatataaaagcttttgaatattgtgatggagtaaagagtccatgtgatggcgagttatcttatcgtggttataatataaaagatttagtaacaggaagtaaaggaaaaaggtttgtctttgaagaaggagcatatcttcttttattcggagaattgccaactgatacacagttaatggaatttcagggaagactatctgattgtatggaactaccgactaactttaccagagatgtcattatgaaagcacctacatcagatattatgggttctatgactcgaagtattcttacattgggctcttacgataaggagaaagaaagtcttgaaattccgaatgtgctaaggcagagtatgcagttgatcgcagtatttcctatgttagcagtatatgcataccatgcttattgtcattatgaaaaaaacgaaagtatgtatattcatagacctgaaaaagatttatctattgctgaaaatttcctgcgcctattaagaccagatacaaaattcacagaactggaagcaagagtactggatatagcattattgttacatatggaacatggtggtggtaacaattctacattcactacacgggtagtaacatcttcaggttcagatacttattctgttatttcagcagcaatgtcatccttaaaaggaaaaaaacatggcggtgcaaatctgatggtaatgaatatgatggatgatattaaaagtcatgtgaaagattatgaagacgaagaggaaattgcatcatatctgagtaagattttgaagaaagaggcgtttgatcagaaaggacttatttatggaatgggacatgctgtatattctatttccgatccgagagaaagggtgttcaaaggctttgtagaacaactcgcaagggataaaggacgtgagaaagatatgaccctttataacaatattgagaagattgcacctaagttgattgcaaagcagcgtcagatattcaaaggagtaagtcctaatatagatttctatagtggttttgtgtatgacatgttgaatattccaagagaattgtacacgccattatttgcgatagcaagaattgctggttggagtgcacatcgcctggaagaattgataactacagataagatcattcgcccggcatataagagtctagtcagcaaaaaagaatatatagaaagagaggaacgataatatgggagcaggaaccagtgcagaggagttttttttaaagagcatcaatgttgaaagtatatttgaatttgtcgaaagaacagattatttgttcctttatagtataaaggaatgtgttgaaaaatcagactgtcatgaaggagtatatctttcagaagtggcagaatacatgaaattatcgattccagaaacatctaagatggtaaaaagtcttgaaaataaaggatatattatctggaaattagatgaaaaaaaagaaagaacgtaccttgttttgacgaacaaggcaattgaattaagtaattgtcagaaagaaaaaatgatagaagcttatgaaaaaatcatatcgaatatacaagaagatgacctggaagttacacggtgtacattgagaaaaatccgacagcttatggaagaaataaaatagtgattaatacaacggagtaagaaaagctccttcatatattagaataaaaatatgactgtttctttaaaaagaagcctgtcatatttttttatgaaaaataaattttgttgaggttaaattgagattgactttgtattgtatcagtatgaaataaaaaggaatcaggtgatgtacaatgaaaaagtataaaatatgtaaaatccttcttgttatactggcaatttttttatgtatggctttttatgaattgctcggaatctgcgttgcatataaaaagcagccggaagtgtccaatacaaccaaaaaagaaacaaaaaatgggtcatggaacgaatgcagtgaaaatacagaacgggcagtaatcatagaaaagaatccagaagcgcttttacaaagagtgcgtttgatcaagaatgcaaaaaaggaaattattctttctacttttgcatttcaatccgatgaaagtggaaaattgattttaggagcactgcatgatgcggcagacagaggtgtacatattcgtctgttagtagatggaatggagagctggattgatatggaaggaaatccgtatttctatggattatcttcccatgagaatgttgaaattaaactatataataaggccaatccgttgaaaccatggaagatgatgggtagaatgcatgataaatatttgattgcagatggaaagagatatattcttgggggaagaaatacatacaattatttcctgggtgattttccgggacataagaactatgacagagacgtgttagtagtttgcgatgaacctgagaaagaaaattcagttaaccagttgttagagtattttgaaacgatatgggaacaagaagacagtggttattttcatgacaataaaaaactggcaaatagaaaatctgtaaagaacgcagttttagagctgcagaacggctatcagaaatattttgaagagaataaggaaagaatctgcgataccgattacacggacgaaacttttgagacagaaaagattgcattagtgtcaaatcctattcacacaggttccaaagaaccagtagtgtggtatcagttgggagaattgatgaaaaatgcaaaaaatcgtgtgaagatccacacgccatatattatctgtaatgatatgatgtataatacatgggaggagattgcagagaacgattcagatttttctatcatgacaaattcagttgcaaataatgggaatccatttggggctgccgattatgcgaaaaacagaaatagaatcttaagtacaggaattaatatctgggaatatgaaggcggttattcataccacggaaaaagtattctgattgacgatgatctgtctgtaatcggttcctttaatatggacatgagaagtgcatatctggatacggaactgatgcttgtaattcgcagtaaagatattaataaacagttggaagagggcatgatggaatatgaaagagtgtcccgccaggtattggaagatggaacctatcgtgatccatatcatgtagagccaatcgaattaacaaagaaacgtcagagaaaaatatttttggtacagcatctgcttggatgggcaaggtatctgttttaataaggaggaaggaaaacgtgtttcaaatattgattgtagaagatgataaagaattaagccagctattccaaaaagtgcttgagaagaatggatatcaggtcaaaagtgcatcggatggagcactggcattagaaatattggataaagagtatattgatctgatcatttccgatattatgatgccggttatggatggttatgaactggtgtcggaactccgttcagcaggatatcagataccggtacttatgatcactgcgaaaggttcctttgatgatatgcgccagggatttctttcgggaagtgacgattatatggtaaaaccggtaaatgtgaatgaaatggttttaagagttggagcactgcttcgccgtgcacagatactgaatgaacacaaaattgtgatcggttcaacagagtttgattatgatgcaatgacggttacaactgataaggaaagtcttgttttgcctaaaaaagaattcctgcttttatataagcttgcagcttcgccaggcagaacatttacaaaacaacagttgatggatgaagtatggggatacgagacggaggcagacccacatacgatagaggtacatataggaagaatcagagagcgttttaaagataaccctgattttgaaatcgtaacaatgcgtggaattggatacaaggtggtgaaaaaataatggaacaaaagaaagaaaaaggattgcggatccgatcctgtctgactggtgcaatctggctggcactcgtattttcaacagtcatatctgcgttattatttgcttttttgaatcatttttttaatctgcctggtagcatacctgtgcttggctggcttttgattttcaatacattgattgcagggctgatcacttcctttatcaatgcaaagttactggaaccaattaccagacttagtaaagcaatgaaggaagtttctcagggagattttgaacagcatttggaaacgaacagccgtatagcagaagttggagaatcttatcaaagttttaacgttatgacaaaagaacttcgtgcaacagaggtgctgcagatggattttgtatctgatgtttctcatgagtttaagaccccgattaatgccattgaaggatatacaatgctgcttcagggagaagaactgtctccggatcaagaggaatatgtagaaaaaatcttatttaacacccaaagactttccggattggttggtaatattttgctgttatccaagttagagaatcagaatataccaatgaaaaaaacagaatatcgtctggatgaacagatccgccaggcatttctttcattggaaacaaaatggacagaaaaagaaattggttttcaggtagaattggaggaagttaaatatactgggaatgaaggactttttatgcatatctggataaatcttttggataatgcgattaagttcagtccttcaaaggggacaattacgatgtttctgaaacaagaacaggattctgttaagttcattctggaagatgaaggaccaggaatagaggatgatgtaaaatccagaatatttgacaagttctatcaggtagatggatctcataaagcagaaggaaatggcctaggtcttgcacttgtaaaacggattgtagatagtgccggaggaacaatcaaagcagaaaaccgtgaatatggtggatgcaaatttgttgtagagcttccaatacagaaagatgagaccatataagtttaagaaaaacagatagaggaggaattacatgacattttatcaggagttgcagttaaatcaggcaggttctaaaaacctgttgaaaaagagtgaaacactaaaagaaaaattatatcatatgtgggtatatctggtgaagatagctgctacaatggcattttgttttttctttgttagtattttcagtatcctatttggaaatgagaacagcattgtaggtgtagtagtcttattatgtctcatggtgtttagaaatgcggatctggggatccacaccggacaatctacgatgcttttggctttgttctttgtaattatgactgtatgtccgcatttagcaaatcagttttcaccggtattgggaatgctgttaaatattgcggcactggctgtgttgattctgttcggatgccataatccattcatgtttaatcaatctacattggttcttgggtatctgctgctatatggttatgatgttacgggaaaaagctatcaaatgcgattagtcggaatggctttaggtgcagcacttacctgcttcgtattttatcgaaatcataaaaacagaacttataaaagaaatctgaaagatctgatacaagaatttgatatcacttcttccagaacaaaatggcagatatgtcagattttatgcgtaccgattgtcctttgcattgcagaactttgtaatatgccacgtgcaatgtgggctggtattgcggccatgtcagcgattttgccgtttatggaagatatgcactacagagtccgtaaaaggattgtcggaaatattgcaggtgttatatgttttacagtattatattttctgcttccttcgtcaatctatgcatatataggaattcttggtggaatcggtgtaggattttcagcacaatatggctggcaggcagtatttaacacatttggtgctttagccattgctacagagacttatggactacaagaagcggttagtcttagagtgattcaaaatgtttttggtgttgtgtttgctttagcattttgtgttatattttattggtttatgtctaaaaaaacggttcatgcgggactcaatgtacgctttaatgaagaaaaacagattacttctgataacgaaattcaaaagtgggcgaaatagattgtaaaatagtactcttagcggaactaatcaggtgataggtaacatttacttcaggatcagttaagggaatccgtttccgccctttcagagtctgctctgagccgggtgctttactgctggaaaaacataataatgtggaagtcctgaccaattcttcaaactcaaattcatctgtctgtatcagaaagcgggatgctggcattttgctctttaccagatttgtccagaaaccgatttcatcacgaagaaggcagttaaaaccgttaagctgtggaaggctcagctgtgaatgttctgccagtttgtgttctttcgggatgcagacatagagctgttccttaagataagggatgcagagaagatttttatctgaacaggactgtggaagaataccgatatcagcattgccggaactgacattttgaaggatttcatccatatttgtcagttttgaggaaataatattatcagggaatctgcgtgacaattcaggcaataatgaccatagaggtacgggagcacaggaatgaatggtaatcgtatgctgattgcgttcaaatgtctgtacggtctcaaccgctttttctgcttcagaaagcagagaccttgcctgttctaccgctacttcaccggtatcggttaattcgatacggtttttaccacgatgaaagagtggaaccccaaaagcatcttccacatcatgcatggttctggtaagagtgggctgagaaatatgaagtttatctgccgcagcagataaggtaccacagtctgcgtaggttacaaactggtaaaggtctgataagtctaacattttgatactcctttctattcataatatgaatagtagatttcgaaattgatattgtatatattcattctaacagaatataatttgaacgtaaacagaaaacaagaaatatcatatttcataaaatgaatacaaaaggaggacgaaacaatggattatgttacattaaataatggtgtaaaaatgccgcaacttggctatggagtttatcagactccgccggaagaaacagagcgctgcgtacttgctgcaattaaaaacggataccgcagcattgacactgctcaggcatatggtaatgaagaaggcgtaggtcaggcaattgtaaaatgcagcctgccaagagaggaacttttcattaccacaaagatctggatcagcaatgcaggatatgaaaaggcaaaggcttcgattgaggaatccttgaagaaactgaaaacagactatgtggatctgcttttgattcatcagccatttggtgattattacggaacataccgtgcaatggaggaagcctataaagcaggcaaggcacgtgcaatcggtgtttcaaacttctatccggaccgttatatcgacattgcacatttcgcagaagttgttccagcggtaaatcaggtggaaacacatgtattccagcagcagaaagtggctcgagaatatcttgcaaaatatcatacacagatcatgagctggggaccatttgcagaaggaaagaatgatttcttcaatactccggcactgaaagaaatcggagcaaaatatggaaagagtgtagctcaggtggcacttcgcttcctgcttcagaatggagtcgttgtgattccaaaatcaacgcacgaagaaagaatgcaggagaatttcaatgtatttgattttgtgctgacagatgaggaaatgaagcagattgaaacacttgataccggaaagagtttgttcttttcccattattcaccggaaacagtggaatggtttatgagtattgtgtaacaaaatagcttcataaaggcaatagcgtattgcggtttatgcgaccggcaatacgcttttgctgtataataggatatgattgtttcctattaggaacgctgtaaatacaaggcttttcggagcctacgaaccacaaaaaataatatttgatctatcacattacacaaaaagccgtccggcgttcaaatcgggcggcttttttgcgtggatagaccggaaggaggcggaaaaataattacagaaatttaacccgcaaaattgtgcaactttcacgaaaaggaggatagtgaatggcagatgaaaaattgaacacaggccccggtgaggagaagctcccggaggctcccgctcctgttacggttgacgagccccaggctccggctcccgaacaaactgccgctcccacaccccagcaggaggggcctgcccagcccgagcccggtgatgtggtggtgtcctttgacaaaatcaatgagctgatgaatgaaaagcggcagacagcccgggccgaggtagaaaaagaggaggcggcaaaagagccgaaggagaaaacgcaggaggaacctcccaccgctggggatgatgaacctaaaaaggcccgtcggggccgtcccccaaaagaggaaaaagcggatcctgctggcaaggaggcggcgaagccccgcaagggccgcccacccaaggcggataaggcggcccccggcgaggccacgccgactaagcgagacaaattgtcccgaagtgggaaaaaggctgcggaggttaaagctgccccggaacccgaaaaggccccacccgaaaatgcggctccggccccggaacaggctccgcctgagccagccgctccgccccgtcctgtggaggaaggaaagctggtctatctgaagctttccgaaatgcatccgttccacacattccgcccccacccgtttaaggtgcgggacgatgccaaaatgcaggaaacggtagcgtccatcaaggcaaacggcgtaatggttcccggtcttgcccgcccggaaaaggatggcaagggttatgaaattgtggcaggccatcgccgccatcatggttgtgagctggccgggctggaggaaatgccctttatcgtccgggaaatgactgaccacgaggcggtacaggccatgaaggacagcaacaagcagagggatcagacgctccccagcgaactggccgccctgttggaactggaagtggaggacatcaagcaccagggcgggcggctgaaaaatgtggccgagggcgatattggaaaacgctccgttgagatcgtgggcgaggcgcacgacatgaactataaaaaggtcatgcgttatctgcggctgaactcccttgtgccggaactgctggacaaggtggacgataaaaaaatgggctttatgcccgctgtggagatttcctatatccgccccaaaaaccagcggctgatcgctgtttccattgacggagaacaggcatccccctctctggcccaggcgaaaaagctccgggagctggacaaggacgggaaactcaatggtgatgtcattgatggcatcttatcagaaaagaaaaaggaggatcgaggcgtgattatttctaccgctgaactggaaaagtattttggcaaggaagccactcccgccaaaatgaaggagcagatcatgactttgctggacgagtggaaagagaaacagccgcccgaactggcgaaggctccgaaaaagatggagcaggacaagtaaccacttcgagacattttgtcccgagggccctgccctccgcatcatggctctggtggtatatatcccccgtcgccgcctgttttttcgtacagccgggagcgggctgtcaagggtgcatcgcaccgccgttttacggcggcctgcccttgacggtctgccccggctgtgctatttccccggcaagcggcgggggtatatcctccagagccgccccctttcccatgattgggaaagggcggggggattgggttgaactttcttattaaaatatcggaggtattgactatgaagcgtccccttgcatacattaccgccgcatggttgagcggcgacagtgaaaacgcagaacaggccgcccgctactgccgggcggtttatgaggcaggcttttccccaatctgcccgcccctttatctgcccctgtttctcaatgacgcagtacccgaggagcataaaagcggcatcgacatgggccgtgacctgctccgccgctcccatgtgctggtggtctgcggccacaccatgaccgaggccatgaaaaatgatattgccgtggcccagcggctgggaattaccgccaccacccttgagggcatcctgaccgtcaagggacagggcaaacgctgatggagtctgtttttgaggctttcatttcaaatcctgccctttacagtgcggggcatctggtgggggaaacgctgcatttccccaccaacacggaggaggtgcagtccctcttaaagcggatcggcgtggacggggtgcgctgccaggaatactttattatctcctttgacagcgacattctcggcctttatgactatctgggcgagtatgaaaacattgacgagctcaaccacctggcccatctgctgaaggagctctccccatcagaacgggaaacgctggaggcggttatggacagcgaccagcattgtggctcggtgcaggacttgatcaaccttacgcaaaatctggactgctacgacctgcatcccggtgtggacaatgaggaaatgctgggccgcctttatgtggaggatatggaaagtctcgaagtgccggacaatataaaaccctactttgactttgaagcatacgggcaggacatttccatcaacgaaaacggacactttgcaccgggcggctatgtgacgaaggtgagtgacgatttccgggaggtctaccacggcccccaggacatccccgctgaacacagggtttttgcttaccctcagctttcgatccgggagcagatggccgcttatcaagaaattattgacggttcctcaaaggaggggttccggcggctggctgaaaaacaccatgaggaacggtaactggacttcgagacaatttgtcccaaggcgaaaggaggcggtgtaactgattgatgaagaaatttcccggagctccatagcgatttctgtccgggccagcaagctgacagcccgggggctggcctatgtgctccgggcggctggccgccagatcgccaaacggcataagaaagcccaaaggccccacggcaggcagagcgtgaaaaagctcatggcccacggcgaaaatgtgaacagcatcgaggtggaggccccgaagctctttgaccgcatggcccgccgtttcaatgtggactatgctttttacaaaaccgggccggacaaatacctgctgtttttcaaggcaggacaggcggatgcaattaccgcctgttttgagcggtactcccgcaggctgttggaacagtcaaaatccagccgcatccccatccgggaacaactcaaaaaagcggcggaacagcttgtaaaggaaccgcccaaaacacaggaacggacaaaggaggtggttcgtgaagaacgatagcatcaaaaaataccttattcccaacatcccgtatctgtttgtcctgtgggcctttctcaagctggggacggcctaccgtctggcggcgggtgcggattttgctcataagctcatggggctgggccagaccattggcccggcctttgccgactttgccccggggcttgctccctttgactggctcgttggcattgtgggggctgtggcgttccgggtaatggtctatgtgaaaagtaaaaacgctaaaaaatttcggcgggatgaggagtatggatcagcccgttggggctgtccgaaagatatagcccctttcgtagatccaaagtttgaaaacaacatcattctgaccgggacggagttccttaccatgaatacccgtccgaaaaatccggccaacgcccgcaacctcaatgcctgtgtgatcggttcgtccggctccggcaaaacccggttctggcttaccccgcagattttgcaggccagcgcagacaaaaacggcggatgcagctatgtgtgtgtcgatcccaaaggaggcgttctcgggcaggtgggccacttcctgcaaaagcgtgggtatcggatcaaggtgttcaattccattgatttcacaaaatccatgcactataacccgctggcgtacatccgcaacgaggccgacatccttaaatttgtggacgctctcatttccaacacaaaaggcgaaggcaaggaaggcgatccattctggacaaaatcggaaaccctgctttactgcgccctcatcgcctatatcatttttgagggccccgccgaggatcggaacatgaacacattggttgacatgatttccgggatggaggtcaaggaggatgacgaggattttatgaacgccgtggactatatgtttgcgggcctggaaaaacgaaagccggattgctttgcggtcaagcagtataaaaagtacaaactggccagcggcaaaacagcaaagtcgatccttatttcctgcggtgcaaggctggctccctttgacatcccccagcttagggaggtcatggcctatgacgagctggagcttgaccgcatcggggatcgaaaaacggcggtgttctttatcatctcggacactacgcaaacctataatttccttgtggctctggccttttcgcagatgttcaatctgctgtgcgagagggccgacaatgttcacggaggccgcctgccccatcatgtacgggtgctgtgggacgaggccgccaacacagggcaggttccccagcttgaaaagatcgtggctgtcatccgttcccgtgagatcagcttaacgctgttctatcagcagttggcgcagtgtaaggcgatttacgataaacacgccgaaaccattttgggaaatatggacagcgtgatattcctcgggggccgggaggccagcaccatcaaggaaatatccgagaactggctgggtaaggctacaatctccatgcagaccgacagccgctcccgtggccagtcggaaagctacagccaaaataaccagcggctgggccgggagctgatgacacccagcgaactggcgaccatgcccggggataagtgtattttacagcttcggggcctgcccccgttctattccccaaaatacgatttgaaaaagcacccgaactaccgatatacggctgaagccgacaaaaagaaaaacgcctttgaccttgaccggctcattaaccgccgcaggcggcccgggccggacgagctgtgtgaggtgtatgccgtggctgtgccggacgatgggctcacaagcgaggacgaggacatcctcaattatgatgacatcgacgatccggacgcctttgcataaatagggctttgggacaaagtgtcccgaagtatgtaacctgccgccagaaatggcggcttttttcatggccgggaataccccccggagaaaaggaggctctatgcagtttttcacttccgctattgatactttgcagactcttgttgtagccctcggcgctggacttggcgtgtggggcgttgtcaatctgctggagggctatggatcggacaacccaggttccaagagccagggcatgaagcagctcatggctggcggcggcatcatccttttgggaaccacgctgatccccctgctgtctggcttgttctaaggagggcttatggattttctcaccgactggctcacgaactggctgaaagagctgttgatcagcggtatcatggggaacctcgaagggctttttgataccgtcaatgccaaagtcggagagattgcggtacaggtagggactaccccggcggcatggaacgccagggttttctccctcatccgccagctttccgaaacggtgatcctgccgattgccggattggtgctgacctttgttgccacctacgagctgatacagatgcttttggaaaagaacaatatgcacgagtttgatgtggcgaatatctacaaatgggtattcaaaaccgcttgtgccatcctcattctttccaacacctttaatattgtcatggcggtgttcgatgtgtcgcagagcgtgattgcggatgcggcggggctcatccaaggctccaccgacattacgccggatatgctgacggagctggaaatcacgctggagggcatggacttggggccgctccttggcctgtggctccagtcctctgtgatcgggctgaccatgcagatcatggggatcatcattttcgttctggtgtacggaagaatgattgaaatatatttaatgaccagtttagcacccctgcccgttgccacgctttccaaccgggagctgggcggcacagggcagaactacctaaaatccctgttcgccgtaggctttcaagggatgctcatactggtctgtgttgcgatctatgcggtgcttattcaaggcatcgccacaggcggcgatccgattggagcgatatggggaaccgtgggctatacggttcttctgtgcttcatgctgtttaagacaggcggcatcgcccagcgcatcttcggggcgcattaaacggacggacttcgggacaaagtgtcccgaggccgggaaaggaggaaacaattttgagtaaggatgtcatattaaccccggaacagatcgccgccgaggagcggcgctggctgtttgatgcgccgattgcggagctggccgaggtaaaaggcgtgacggtggacgaggcagttaagctgcggacggacgcaattttgcaggaggccgctgttcccatcgaagttacggttcgcccgattgagccccaaggcaagctcatcggctttgccagcgtcaactatggcggtgtagtgatcgacgatttcaaggtggtggatggcaagaacgggattttcctcggggctcccagcaaacccgatcccaccagcaggacgggctaccgctccacggtgcggatcaatgaccgggccacccaggagcggctcaatgcggcgggagcccaggcgtaccattcagcggtggaaaagctcatcgcccgggccgaggcagtccgccccaccccgatcaaggagcagatggcacaggccgcaagggaggctgggaaggaaaatgccgcccgaaccgccccggcaaagaaaaaggaggcccggaatgacaggtgatgtgacctcgagacaaattgtcccgaagtctccagcctgcccggaggggctgtttttgatggacgggattgaagggctgcgctctttgccgaagcactcggttgatatgctccttaccgatccaccctatggcactacccggaatttttgggatgtgccgctcccgctcccggagctgtgggaggcggtcaagtgggctgtcaaaccggatggcgcagtgctgtttttcgcacaatgcccctatgataaggtgctgggggcatccaacctctctatgctccgctatgaatgggtgtggtacaaaagcaggtgtactggctttctcaatgcaaggcgggctcccctaaagcggacggaaaacattctggtgttttatcaaaaattgccctattacgatccgcagtttgaacagggcaagccctataagaaaatttcccggacaggggacaacagccccaactatggaaaattcctgcgttccagcagcggatcagaggatggccttcgttttcccggaaacctgctggccttttcttccgtacagcgtaccgtccacccaacgcagaaacccgtggagctgtgcgagtatctcatcagaacctatacccggcccggggaggtagtggcagacatctgcgctggctccggcacgactgctgtggctgccgtcaatacgggccgccgctttgtatgctttgaaaccgccccggccttttacgccccagctacagaacgcatccggctggctactgaggcggtcaaagccgggcagaaaggagtatgactatcggaaactattctatcatttacgccgatcccccttggcagtaccagcgcaataaagtacagggggcggcagaaaaccattatcccacaatggggattgacgatctgtgtgcgctcccggtggctgatctggccgccccggacagtgcactttttttgtgggcgactttcccccagctcccggaggccctgcggctcatagaggcgtggggcttccgctataagtctgtggcctttgtctggctgaaaaagaataaaaaggcggacagttggttttatggccttggcttctggacgaggggaaatgcagaaatctgcctgctagctaccaagggccatcccaaacggcaggcggcaaatatccatcagtttatcatttccccgattgaagcccacagcaaaaagccggacgaggcccgggaaaagatcgtggcccttatgggcgacctgccccgggtggagctctttgccagacagtccccgcccggctgggaggtgtggggaaatgaagtgaaaagcacgatcccggactttgggacaaagtgtcccgaggttaaaggggccggaaaggaggctgatccatgccctatgtgaatgtacccaacgacctgtcaaaagtaaaaaccaaaatggccctaaaccttaccaagcgccagctcatctgttttagctgtgcggcggcggtaggcatcccgtcctatctgctggcccggggctctatcggcaataccggggccatgttccttatgctggccgtgatgctcccggcgtttcttctggccatgtatgaaaaagacgggctcccggcggaaaaggtgctgaaaaacatcatacgggcccggtttctgcggtccggagtcaggccctatcagacacaaaacatttacgccccctttgccgaacggggcgctgtgagaaaggaggatgtgattgcgaaaggcaaatccaaccagcggaagaaaaaccgcaaaggctaaaaaccgggcggccctgtccgcccagcagacgatcccctatgtggcgatgcatccggacggggtatgcaagctccccggcgggctctacacaaagaccgtggaatatgaggacatcaattattccgtggcatccactgaggatcagactgcaatctttggcggttggagctcatttctcaactactttgacagctccctgccgttccagctttcctttatcaaccgccgctcccactcccggagccgctataaggtaaacattccccaggcggatgatgattttaacagcgtccgggaggaatttaccgggatgctgaaaaaccagatcgcccggtctaacaacgggattgaacgctccaagtacattactttcggcatcccagccggagggatcgtggaggcccggccccgtctggagcgtgtggaagccgatgtgatgggcaactttaagcggctgggtgttccctgtgaaccgatggacggacgggcaaggctggccctgcttcacagccagatgcatccgggcaaccgggaaccgttccgcttttcatggaaggacatcccgcagacggggcttggcaccaaggactatatcgccccggacagctttgacttccggcactcccgcctgttccgggtgggccagtattggggcgctgtttcctacttgcagattttggcgtctgagctctcggataaactgctggcagaaatgctggagctggatgcggaaatgaccgtaaccctccatatccagacggtggatcagctaaaggccatcaaaaccatcaagggaaaaatctccgacatcgggaaaatgaaggtggaggaacagcggaaggctgtccgggccgggtatgatcccgacattctcccgcccgacctcattaccttttccaaggatgcggcggagctccttgccgacctccagtcccgcaacgaaaggatgttccttttgacttttacggtagtcaatatggcccctacccgccagcggctggaaaatgatgtgtttaccgtgggcggcatcgcacagaaatacaactgcgccctcaagcggctggactggcaacaggagcagggctttgtgtcctcgctggccctcggctacaacgaagtggagatccagcgtggtatgacaaccagctccacagcaatttttatcccctttatgacaagggagctgcggatggacgggcaggccctctactatggcatgaacgccctttcccacaatgtcattatggctgaccgcaaaaagctgaagtcggccaacggaatgtacctcggctctacaggctcgggaaaatcctttgcggcaaagcgggaactgctcaatgtctttctgaccatcccccaggatcggattatcattgtcgatccgatgggcgaatatgccccgctggttcgcaggctgggcggacaggtgatcgagattgccccggacagccaccaccacctaaacccgatggatgtggagcttaacatggccgccggggagagccctctttccatgaaggcagatttcctgctttccctgtgcgagctggtggtaggcggaaaggaaggcttacagcccatcgaaaagacagttgttgaccgctgtgtgcggctggtgtaccgggaacaggcccttgggcttgatacgggaaaaaccccgcttttgcaggacttgtacgaggagctcttgaaacagccggagcccgaggcccggcgtgtggcaaccgcccttgagctctactgcaccggctccctcaacctgtttaaccatcccacgaatgtgaaaaccgacagccgggtggtgtgtatcgtgctgaaaaacatgggagaaaacctccgcaagatcgccatgcacatcacaaatgaatttgtgtcccaggcggtagataccaacttccgggagggcgtggcgacatggtgctacttcgatgagttccatgtcctgctccgtgatccgctgaccgccagctattttgtggcggtgtggaaaatgctgagaaagaaaggctgcgttcccagcgccctcacgcagaatgtaaaagaccttctggccagccgggagattgagaacattctggataacaccgattttatgattttgctctcgcaagctcagagcgaccgggcgattttggcaagacagctcggtatttccgagcatcagctttcctacattacccactctaattccggcgagggcctgctgttttacgggaatgtgaccatcccgtttgtggatcggttcccgaagggggaaatctatgacctcttaaccacccgaccggaggatatgaagaatgaagcgaaaaccgaataaaccacgcccggagtcccaaacgcatacggaacccggaggcggagctgccgagcccggtggccctgcttttggggctggctctgaacaggcgcccggggcggctggcacttcgggacaaagtgtcccaaagtcaaaatttcggcagaaaagccagcaggaacaggcggcggcatccaagctccgcatggaaaagcggggcgaaaaacgggaagccgcccgggaaaagctggcaaagcagaagccgcccaaacaaaaaggcccgatccgtaaggcggcgggggccgccggatggggcgttcacggctttgtgcatggcaagctctacgaggtggagcaggaaaatgtaggaacggaaggggcccaccgttcggaacttgccggggaggttatcctgcggcatggctcccggtttgtaaagcgcaaagtccgggagcatccggcaagggcggccagccgggccgaggccaggtatcagaaagcagcggcggattatcatttccacaccgccgcacaggagcacccggagctttcccaaaactattttacccggtactggcagaaacagcggcttagaaggcaataccagaagcgggcgaaggaggccgcaaaacagggagccaaagccgccgggaaaacagccgccgccacggaaaagctgacagcccgggccgccgggtttgtgaagcgccatccagtcggatgcctgctggctctggcctgtgtccttgtgatcgtcctgctccagtcctgttcgtcctcgctggtgtccatcggcaacgccggagccggggcgctgggggccaccacttacccctctgaggatgaggcgattttaggggcggaggcggcttatgccgggctggaggcagaactgcaaacctaccttgatacctacgaaagcacccacgattatgacgagtaccacttcgatctggacgagatcgaacacgatccctatgtgctcatttccctgctgtcggcgctccatgagggggaatggacgctttcacaggtggagggctccctgcaaatgctctttgaccgccagtatattctgacggagcgtgtggaggtggagacacgctacgacagcgacgatgaaccctattcgtggtacatctgctatgtgacgctggaaaacaaaaacctgtcccacctgcctgtttccctgttgagcgaagaacagatgtcccggtactccatctatatgtccaccctcggcaaccgtcccgacctgtttcccgactccccctatgtagacaaatacattaccaacccgccggagggctatgaggttccgggggaatatctggacgatgaaacattcgccgctattttctcggaggcagagaaatacatcggctatccctatgtgtggggcggctccagcccgtctacatcctttgactgctccggctatgtgtcatgggtgatcaatcactccggctggaatgtgggtcgtcttggggcgcaggggctttacaacatctgcactccgaccagctccccaaggcccggcaaccttgtgtttttcaagggaacctatgataccccgggcgtgagccactgtgggatttatgtaggcgatgggcggatgctccactgcggagatcccatcggatacgcaaacttaaatacaagctactggcagtctcatttttacgcctacgggcgtttaccatgattggaggtcatttatggcaacagcaaaaagcatgaaaatccaagccgagattgataaggtcaaggccaaaatcagcgaacagcaggcccggctcagggagctggagcagaaaaagctggaggcggaaaacagcgagatcgtggacatcgtgcgtggcatgagcatcccccttgcggaactgcccctgctgtttgaaaagctgaaaggcggcggggctttgggacaaagtgtcccgaagtccgaggatgaggaaaaggaggaaaactgaatatgaaacggtttcgagttttgacagcggtgctttgtgccgctgttttgttatgcggctttagcgttcccgcctatgcctacgcaggcggcgagggcgaggactacggcgatcccacaatggaaaccccggccccggagccgactattacgccgggcgagggcttttccgaggagggaaaccttgtaacccgtgatctgctctatgacgagcacaccaacaagcagtttattaccgtacagaccagcggcggcaataccttttacattgtcattgattatgacaagcctgtggacgaggaaggtgaacagtatgaaacctactttttcagcgttgtggatgagggggatctgctggccgcagccgaggccgctggcgtggaacaggcggtctgctcctgtccggagaaatgtgcggcggggactgtgaatacagactgcccggtgtgctccgtcaatctggcaaaatgcgtaggcgcagagccggagcccgagcctgccccagagccggagccggaacccgagaagccgggcaacgccgggatgatccttttggtgctggctgtcatgggcatcggcggcggggccgcatggtatttcaagatttactgtccgaaacaccagcaagctgaccagcccgaggaggacgatggcggggagtacccggactatgacgagtttgaagatgacggccccccgtgggacgaggaggacgaaaccgaagaaaaggaggaaatcagatgaattttaccaacagtccctttgaacgaatgatgaaagaaaaaccccgtccccaggctcccgctgagaacaggccgcccaggggctccgcctgttatggctgctgttactggcgggggatcgcctgtgtgtcctgctacaaggagcttttgaaggccggggctggcgggaggtgatggattgtcccgtgaactgacacgcaaggaaaagacagcgatccgctctcttgtggtaacatggtgcgctaactatgaccgggaatacggatgcctgccgctggatagcgattgctatatgctgggtaaatgctggacgggatcatactgccgctatttccgggagtccgtcctgccccttgatccggcgctggaagtggcccttatgagcgagggcccaaggccggattttaagatatgcccggtatgcggcgggcctgttcccccggacaggcggcaggcgtactgctcggcggcctgtgcaaagaaagcccaccgccgccagcaacgggaatatatgcggaaaaagcggggtgcatccgttgacaattagggcctgtaaaacccgcttatagcaaggctttccggggccatttcgttggcctgccgtatcattctacggtctggccccgtttgccccgatgctgtcaacatccatacagcgggactttgggacactttgtcccgaagtacccgctttctgagaggaggaattatgccgaaatattaccccatcaatgaggaggccgcccggcgtgccaaaaacgccaacagcttttccgactatgttcccggctccgccaccgccgcttaccgtgaaatggtggatcgggcctataccctcgggaaacagcagaaagggcgtgtcgatcccatgtaccacgaaaagattgacgggctcatagaccgctatgcccgcaagctggcggagaacatcaaccagtgcaatctcatagatgcccgtgtaccctcgatcctcatcgccggaggctccaacttcccggtgcggaaaaaggaaaagcagaacgccgcccgggataagaatatgggcgaatatatgcagatcgagggcctgctggataaggtgcgctcaacaggtatgggcgggatcagcgcagacgatgaccgggccgtggaaaagctggaggcgaagctggcagggctggaggccatgcaggaggaaatgaaaaccgtcaatgcctactaccgcaagcataaaacgctggagggctgtcccgtcctgtccgccgaggaaattggaaagttccagtcctctatggcatccgactggcgcaaaaatcccgtaccctatccgtcctatctgcttaccaacaacaacgccaacatccgccgcacacgccagcgcattgaggatttgaaaagccagtcggaatatgcgggctgggcctttcccgggggacgggcggaaatcaacgaaggagaaaaccgcttgcagctcttttttgaggaaaagccatcggaggaacagcggcgggaactgaaaagcaacggttttaagtgggctcccagccagggagcatggcagagacagcttacgaaaaatgccatatatgcggcgggccggatggaatttttgcgcccggaggatgggcagagcccttaccagctccagccctttgcccggaaaacggaaaaggatatgacacgatgaaggaggtgtatttgtggacaaaaatcaaggctattccattttgaaggctgtgatgctggaaaatggcaggggctttgcgctggggcatcatcccacagctccatccccctatgtcacatgggcctgttacgatgataagaacggccagcggcagtatgaatggggacattacggcaacgatctggccgctatggaacaggatttttcagaccgggtaaaggactatcagcggctttactatgtggggatcgtgcagaccgaggcccccggcctttacaaatattactctacccagcggcctgtggacatcgggacattccccaaaccgccccacaatgccccggatgagatcgtcaactatgaccgccgcatcccggtggagggcggcgcatttctggcatgggggcatctgacttatacaagaccgctgaccgaaaaggaggcgtctgactatgagctccgtcctgcctccgtcatttctgaattatcccgaaaaaacgatgacaggcccctctcgattgcccagcagatgaaagaggccggagctctggccgaagccagccagggcgatcccatccataagaaaaaggcccccgaccggggcgaccgataggaggatttgtatggaagaaagatataacccgatgaaaagtgcggagatcgccaccgagcacaattacaatatgctggacggtgttctcaataaccaggccccacccccggaggaaaaggagctggataaggttaaggaaccgccccacaagcgccggagccgggaacgggaggaacgatgacaaagaaacgccgccgcccgatccatctccatgtgatggtgtccgaggaggagcaggcccttattcaacaacgcatggccgagtcgggcatccgcaatatgggggcctatatgcggaaaatggccctcaatggctatgtgctccatgttgacctctcgcccgtccgggagttggtatcgctccagcggcggtgctcaaacaacctcaatcaagtggcgatccaggccaacacctacggcgggatttaccccgaggagatcgccgctttgcaacgggactatgccgccctgtgggggccgctgttcgatctgctgaaaaagctctccgcattggtggagctctgatcctgccggggagtggcgtatgccgctccccggttttcactacttcgggacaatttgtcccgaggtgctgaaagccggaggcatccttgttgtccctcccggacagaggtataattatcatgtaaggaaccataaaccacacttttcaaggaggtatcaagcgatgcggatcattctgaaacttttagcggccccctttgttctggccctcacgctccttgtggcagtattgaattttgctttttcctttgcgtcatgggtgttctgcgccctgtcctttctctgtctgatcggagccctgtttgctttaatcacgggggatcgctggggcatacaggggcttgtgatcgcctttgctgtttcgcccttcggcctgcccgctgtggcggagtggctcattgacaagctggacagtctcaactactcgctaaagagttttatcacaggataacgctttgggacaatttgtcccgaagccccctgcggcggctggacggacagccgccgttttcttttggaaggaggtgtgctcacggctacaacttatatccggccctacaaggtggcggctgggaaaggcgctgtccagacaatggaggaacgctttaactatgggcttaatccgaaaaagctgggagccctgtcctcatacctctgcgatccggccacggctcccgctgagtttctgctggtaaagagtcagtaccaggcggaaatgggccgggccgtagagcgtggagccctgttttttcaaatccggcaggcgttcccacccggcgaagtaacagcagaggaggccaaccagatcggctatgaaacagccatgcgctggacaaagggaaagtatcagttttttgtctgcacccacacagacaagagccacctccacaatcacatttatttcaattcaacggcctttgaccgctcccggaagttccataattttatcggctccagctttgctctgcggcggctctctgaccgggtgtgcgttgagcatgacctctctgtgatccaaaatccaaaacagcacagcaagggccggtatctccattatggccagtggattgtggaaaagccgccctctgcaaaacagcgggtgcggctggccatcgtggaggctctgaaaaaacagcccgccgattttccggcgtttctgaggctcatggaggagaccggctttctggtaaagcatggccgtggcggtgtgatctcctttcttgctcccggacaggataagcccacccgcctgcgggcatctaccctcggggatggttttgatcccgaggacatccgggctatgattgccggggagcgtccgatcccggagctcccgcaggaggctccggctcctgcccggcgtgttaatctgattatagacattcaagagcgcatggcacagggcaagggcccggcctatgaacggtgggccaaggtttacaatctgaaacagatggctgctgcgctccagtacctgcgggaaaatgatttgatggactatgaggcgctggcggccagtacagaaaaggcagtagagcgttttcacacgctgtccgaggaattgcggcaaacggaggcggagctggaaaagacctccgggctcatggcggctactgtggactacgcaaaaacccggcctgtgtttgacggttacaaggcggcccggtacagtaaaaaatatctgtcggagcatgaggcggagcttgccgcttaccgggcggcccgggccactatgaatgagcttttggacggtgcaaaattgccaaagatggcggatatgaaaaagtcccgccaggaattggcgggaaagaaaaaagccctctatgcggaataccgcaaggcccaggcggatatgcggcaggctgtggcggtcaaagcgaacatagatcatctgctcggcgtgacagacgggcgggaaaataaggcccaggagcgatagcgacaggccgcagacaacaggcgcatagcgccggaactttgggacaatttgtcccgaagtccagcgggtttggggagctccccaacaagcatttttgcgggcctgcggccagcaaaaatttcggagtgtggccacacccgaattgcttgccgaaacgcgcaaccccggaagtggcgcgaaaaaacggaggcgcgtgtttctctttacgcatcctccgtttccttggccgctttcatcgcttggattgtagcttcaacgattttcaattctctttcgtccaaggcgttcaacatggcatcaatccgcttcctgcactcgctcccgctattctgggacgggtaaaagtattgatccaccgatatatcaaacattgtgaccatctgataaaaggtgttgaagcttggatgctgaccatcattttcattatacataatggtacgcggagcgcggtcaacaatataggccagttgctcctgtgtcataccgctggcttctcttgcacgcttgatggcgagccctatatcgtgaaaatcaaagcgtctttcatctcgttctatcttcataacatcacctgatatgattttacatttcatgtgatattatttgaacgactgtgtatttcatactactgactatttaatttcacattcttttcttccaaaacttgtattgttcgagtcgaagaactataatatactctatggaggtgcagaatggattatatgacactaaaagaggccgccgaaaaatggggcgtgacacctcgtagagtaaattactattgtgctgccgggcgtattcctggtgctgtaaagatggcaactatctggctaattccaaaagatgcggaaaagccgattgacggaaggacaaaacaaggaaaggagttgcgccatgaataaaatcctgattatagatgatgacaaagagctgtgcactttgattaaacgtagcgtacaagcagaaaacatagaagctgatttttgtaataccggaaaagagggcttacaaaaattaagagagcaggaataccagcttgtggtgctggatgtgatgatgcccggcatggacgggtttgaaacgctggaagaaattcgcaaggagtacagcttgccgattttgatgttcacatctaaaaatgacagcatttctaaagtacggggcttacgggccggagcggacgattatcttacaaaaccgtttgatatggatgaactgattgcccgtattgcgtctcttattcgccgctacactcgctttaatcagcaagctggagccatacaaaagctaaatttttacggattgcagattgaccttgaaaatcgttctgttactacatcaaacggcacttttgaactgcccccaaaggaatttgatttgctcctgtactgtgcaaaacatcaagggaaaattttgaccaaacagcagatttatgaggaagtatggggcgaagaatatttctatgatgacagtaacattatggcgattatcagccgacttcgtaaaaaattagaagtcaatccttcaagcccaaagtatatacaaacggtcaaagggattggctaccggtttaataaggaggtgtagtcagcatggaaattatcgtatccttgtccattgtgattgctgttgtggctgtattgacttccatcgttctcgttcggcgtgtaaaaaaacaaatagcagaaatgaccgatgtgctggttgatgtgaaaaacggaaatggcaaccggcgtattctatctgcaacaaatgaactgacagcacctcttgcctatgaaatcaatgagatcgttgtggcctatgaaagcagactttcaactgtacggcagacagaagaaaccaaccgccaacttatgacgagcctttcccatgacgtgcgaacgccccttactactctgattgggtatcttgacgctgcacacaaaggactggtcacaggaaaagaccgggatgattatattgaaaccgcccgccggaaagcccatgatctgaaagaatatattgatgtactctttgactggttcaagttaaattcaaacgagtttgctttggaaatccagagcgttgaggccgcagagctgacaagaaatatcctcattgactggataccgatttttgaggataaacaggttgagtatgacatcgatattcccgaacagcctgtccgggtaagattggatatggacagctatatgaggatcatcaataaccttattcaaaatgtaatcgctcacagccatgcagacaaaatcaaaattgccctgtcaaagaaggaaaataacatggagttgctgctggcggataatggagtgggaattgagaaggaagatttgaaacacatttttgaacggctctataagtgtgacaaaggacggtctgaaaaaggaagcggtcttggtctttctattgtccatcagcttgtagaaaagatgggtgggagtataacagttgaaagtttgccgggaaaaggaactgaatttatgttgctttttcctttggagagttaagcgggttcccgtctttatggcgggagcctttgtcattttactggatttcaaattgcaaggttaatgcaaggttgcggcaaggttaatgcaaggttggcatgatagaataccttacagaacaggaggttttgaatatggatacaaattatatcattgaaacaaaaaatctgacgaagcaatacggctcacaaaagagtgtggctgacttaaatattcatgtgaagcgtgggagaatttacggtctgctgggcagaaacggagccggaaaaaccactaccatgaaaatgctgttgggcttaacggagccgacttccggggaggtcaaaatctggggaaagtctttgcaagggaatgaaaagaagttgctcccccgcattggcagtctaattgagtcccccggcttttatcccaatctgaccggcacagagaacctgcgtatctttgctactctgcggggcgtaccaaacaatcatgctatcaaagatgctctggatctggtaggactgccctacaaagataaaaagctcttttcacagtattctcttggcatgaagcagcggcttgccatcgcccttgccgttatgcacgatccggagcttttgattttggatgagccgatcaacggcctcgaccccatcggtattgcagaagtacgttcctttattcgtgagctttgtgacgcgcgaggaaaaaccattttgatttccagtcacattctttcggagatttccttgctggctgacgatattggaattatcgaccacggcgcattgctggaagaagaaagccttgctgagctggagcaaaaaagcagtaagcatatccggtttacgctctctgatactgcacaggcggcaagaattttggagcgcaatttccatgaaaaccatttctccatacaggacgaccacaatttgcgcctgcacaaccttgatctacctgtggggaaaattgtaactgcctttgtagaaaacggattggaggtatcagaggcgcatacctgtgaagaaagtcttgaggattatttcaagagagtaacagggggtgagggaattgcttaaactggttcaatgtgagttcgcgaaattgaagagaaaaaaaatcatcccacttgtgtttttgtccgcttttttatttcctattcccattacctttctgatggcaacaccgagaatgttggagaagtacccaaataaatcagtcctttttgatggattgttcaatatggttatgggatatggcgttatttttctcttgccgtgtatcatcggtgtcattgcagcaatgctgttttttatggaacgggacaatgacactttcaaaaatttacgcacaatcccggtaacaagtacacagatgattatggcaaagatcattgtgctatttatttttggagttatcttttgccttgcttccatgcttgctaccattgtttgcggcagtttctcaatggaagtgcatggtcttacctataaactacttgttgcagttgaacttggaatattcattacagcgggaactttgccgattatcgtacttgtggtctttttcagcaaaacatacatcttctccattctgctatgtgtgttttacagtgtagtgagccttaccgtcgaaacattgttcggaacattgcctaaatggttatgttggctcatgcctatcccgcttacaacgctctggggtgcgggagatatggtgaaacatgggtttccattgaatgtaaatgccttggaagcaattattccctcaacctttcagacggttatcattcttgggataatggctgttgcatcaatctcattgatcgacttcttatacaagaaaaggggggaataaaatgtatcggatcattaaaacagaattatggaagttaaagcggtatcatatcatttgggctggtattctgctaatgcttctttccgttggaattactctttttgcttctactgcattagatggtacagtttggactttccctcatttggtcgaacgcgtcattcaaaataatacgacaaccatttttcctatgtgcattactctgattgcaggatatatcattgctcgtgaaaaatcagatgataccttaaaaagcattatgacaatacctgtttcctaccctgcgttgattggcggaaaactgattgtttgcggtttcctgtccgtatttttgggtatggcaagtacattttttactgtcgctgcggaattacttgttggctttccgggattttcggtaacagccgtaatacaggctttgatacagatcacccttaataccttatttttgtatatagccgtaactccgattatagcctttaccgcccgtattcctaacgggcacatgataggtgttattcttgcatttgtctatggctacgggggaatgttcgcagccggaaatatgtcccttgcaaatctctatccgattacagcgagtatgggactgatccagtaccgaagccatgatgcggctgttcattggaatataggcttatgcagcctaagtatgatagtcgtcttattgatttctgtggctattgtagttacaacaaaaaatgtttcatccgcaaaagttgttaaaaagccgaaaaaaaccgccctcaaaaaaggctggtaaacaggaggacttacacatgaagaaaaaaatattgattgggattggtgccggtgctttcgtggcaatctgttttggtattttactgctttcaggtgcaggcagcacctattactattcacagatcgacaacaccaagatcgagcagacgggatctgccggaggtgtaattaactttgggggaagcatggactactcctacacgctgcgttgttatgacgaggacggaaacgaaaaggacattacctttggaacatcgagggaattgaaagaggacgcctttattcgtctgacggtaatgcccattcgtggagtgctggaatgggttgaagttcagtatgacgagcttcccacagccgtacaaaaagaatatacagcaccgcaataaagagaatagataattgattatcacctaaaatatagctgccgcacgacggcaaaagaaaaaaagccgtcgtacagcagacacattttcacgcgcctatgaaatggcggctttgattttcagagccgccgtttctttgcgtttacacaaacctatgacgacttgcagggacacggtagccgattggaggttaatttaccgtgtccttctttttatttcgcagtatccatgacctgcaccagttaaaaaaagcgtagctcccccatcggagcagtccggctttgaatgtgaaattaaacagtacataaccgataatatattttcatgcgcttgtgcggccttgtgtcgcgcaggcgcattttgctttccagacttcgagacaaagtgtcccgaggtgcggtgccgttctccgccgttactccatttcgtttccgaccaaccccgaacaaactgaaatggaggattttacgatgactactatcaatttgaaagatttttattattggtacacgcaggatcagcttatcgaagtttctgacgaggtggccgaggtattcaaggccgatgcccgctatgaaatggcctaccagcggcggctctcccggcacaaggcgcagtattctctggactgcgatgacgggattgagtattccgcttgcctgcatgagccgaccccgcaggagctccttgaacggatggaaacctttcttcgtctgtggaacgctctcaattctctgccggagatccaaggccgtagaattgacgcacatatcattcttggcaagtcgattaaggaaattgccgaggccgagggcgtacatgaggagtctattcgccagtcgatcaagcgtggccttgaacgcatgaaaaaaaatttttgattttttcttcttaacccacttggaattgatgaaaaaatgtctcggtttatgagaggaggttttcttcttaacgcaagggaataacggcaaccctgagtaagtacggggagccagacggtgggtgcgcggtgacatttccctaaagagattgagcgaacaacaccaacactgtaaatgggcccggccatcccaaggccatgatccggcgctgaacaggttggctgcctgttcctccgggcttgtcgctttgcttgcgttgagagcgccgcacagaaaataacgattgtctttggacaggccaagtaaatatgtgcggcgctctctaatattcaaaaactataataaacctcgagacaaagtgtcccaaggtggagtaaggcaacagaccagcatcccggcggtgctggtctgttgcgtttccccaccaaacagagggaggcgttctatcaatctgcgaaggaggtttaccgtgaaattaactacacaggaacttgaacaaatgagaagcgttgacattggcgcggtggctgccgagtccctgcctgatgtgagcggtatgacctttgacaatgcgctttcccgaaaggagcgcatctctcgatttttgcagactgtcaaaaatccatactgcttttgcatcggtggtgttggcgtgaaaattgaatttgctgaaagcgggccatctctccaagataagctgacggatttcctgctgcggcaaagaagcgggctgtaacttcggttacagctcattttgcttcttcgagacaaagtgtcccgaagcggaggcatccttgttgtcctccccggacagagttataatataagtgtaatgtgatagggaaggaggaacaatggcacgagcaaaaaacagagggtatcagcagagtttctctccctcttacacaatccgccgctggcggctgggcatctatatccggctttcaaaggaagatttgaaaaaaggaaaagacgatagcaacagcgtaaagaaccagcgtgacctactgaacgatttttaccgacgcaacattgacgagtttgaaagtatcacggaatatgtagatgacggacatactggaacggacgctaaccgtgaagattttcaacggctcttggcggatgtcgtgagtggtaaaatcaactgcgttatagtaaaagacctgtcccgcttcgcacgaaattatagcgatgccggaagtttgatcgataacctgtttgttcaaatgggtgttcgctttatcagccttgctgagaatgtggacagctacaagaaccccgacagcgtttcaaatatcatcgttcccattacaaacgtgatgaacgataattactgctatcagacttccaaaaagatccggcaggtatttgattacaaacggcgcaacggccagtatatcggagcatttgctccttacggctatgtaaagcacccaaaggacaagcacaggctgattgttgatcccgatgctgctgaaaatgtcaaactcattttcacaatgcttattcaagggtcatcaaaacgtgctatcgcgctgtacctgaacgaacacggcgtaccgagcccctcggcttacaaggtacaaaagggcttgcctgtttcgacaagagggtatgacgatcctatgtggggagtccgcatgatccactccattcttaccaatccgacctacaccggggatttagcccaaggccgaagccgggtgaaaagctacaaggtacaccagattgaagctgttccccgcgaggaatgggtggaagtggctggaacgcatgaggccattatcgactatgaaactttcgacaaggtacaggctctcttacagcgtgatacccgtacttccccgaaaggccgtgaggtacatttattcagcggctttctgaaatgtgccgattgcgggcgggccattacccgatgcgttggcaagaacaacaatgtatattattcttgctcaacctacaagaaccgttcccggacagcctgcaccatgcactcaatcaagcatgaacggctggaggctgctgttctgttcgctgtacagcatcaggtacatttggctgtttcctactcggaaatcgtcacgcagatcaattccgctccaatcaaaaaaagccagtcttaccgactggacgatctgatagctgcaaaagagcgagaactgacaaaaataacacgctacaagcaatctctttatcaggactggaaagacggtgaaatcacccagcaggaataccgggatatgaaggcagactatgaacggcagacttctgatatttccgcagtgctcactcgtctgaacgctgaacgcgcagaactggcaaacggtgtagacaacgagcatcctgcactggtagcctttatgaagtatcagaacattgaagccctcaaccgtgaaatcttggttgagcttgtggactatatcaaggtctatgaaaacggtaatatcagcgtgaaattcaaatttgctgacgagctccgcaagattgccgagtacattgaaatcaacactacggaagataccgcagtagcgggctaacccccgctacgaacccctttgacagtgtgttttcctaataggcgctaatcatatgaaaattgttatacggaaaggataagaaaatgaaggaacagaatcatccgaatgtgattaaaattcgaaatgcacatgttcataacctgaaacatatcgatgtggatattccactaaataagattgtgggaattgccggagtgtccggttccggaaagtcatcccttgcactgggagtgctgtatgcggaaggttcacggagatatcttgatgcgttatcgacctataccagaagaagaatgacacaggcaccgagagcacaggtggatgaggtactgcatattccagcggcactggcattacaccaaagaccgggggttccgggaatccggagtacgtttggaaccggatcggaactgttgaacacattacgactgatattttcaagacttgcaaatcactgttgtccctatggccattatctggaacccacacttgatgtggcggcagggaaagaactttgttgtcctgtctgcggaacacattttttggcaccatcagcggaagaactctcttttaattcgcagggagcctgccagacttgtggcggaacgggatttgttaggaaagtagatgaagcttcgttggttccggatgaatcactgactattgatgaaggtgcggttcttccatggaaaacattgatgtggtcactcatgacagatgtatgcagggaaatgggagtccgtacagatgtaccatttcaggaacttacaaaagaggaaaaagagatcgtatatcatggaccggcagaaaaaaagcatattttttataaagcaaaaaatacaaaccagtccggcgaacttgattttacatatttcaatgctgtatataccgtggagaatgccttatccaaagtaaaagacgagaaaggcatgaaacgtgtggaacgtttcttgaaagaggatgtatgtccggattgcggcggaacaagactttctaagagagcgagactgccaaaattatgcggcatcacactggcagatgcctgtaagatgtcactttcagagcttgtagagtgggtaaatcatgtgccggatgccctgccagaagaaatgcggttaatggcagaaaatatctgtgaatcttttcagatggttgcaaaacggctgatggatctgggtctgggttatctgtcattggacagagcggcttctactctttcgacaggggaacggcagcgaatgcagcttgcacgggcagtcagaaaccggactacaggagtattgtacgtgcttgatgagccgtctatcggtcttcacccatccaatatcgtgggactaacggatgtcatgcatgatctgattgcggatggcaattctgttattctggtggatcatgataagcagattctttcagaggcagactggcttgtggagatgggaccaaaagccggggcagacggaggaagaatcattgcacaggggacgattcctgagattgaagcaaatccggattcccaaattggaacatttctgaaagaaatgcatcccatttatcggaagaaagcatctgaacaggaaatgttttctttgggaaccatccacctttcgacagatgctattcatacggtaaagccgctggaagcagatattccaaaagggagacttacagtggtgaccggtgtctccggttccgggaaaacgacattgatactggaaagtctgattccggcattagagtcgatgataaatggaacaaaacttccctctcatgtgaaaaatattactgcggaagatattgaacaggtaaaactgattgatgcggcaccgattggaatcaatgtgcgttctacggtggcaacttatgcaaatgtgcatgatgagttgcgaaaggtatatgcaaaacttccggatgcaaaggaagcgggatataaagcaggggatttttcttacaatacaggaaaactgcgttgcccgacctgcgatggaacaggttctatcagccttgatgtgcagtttttaccggatgtggaagtaccttgtccggattgtcatggaagcagatataacagggacgctgggaatattaaaaggaaaacaaagtctggagagttatattctctgccggaactgatggatatggatgtacaacaggctctacgtgcctgtgaggatatgaaaaagatatgctcaagattgcagattataaaggatctgggactgggttatctgacattaggcgaagcaactccaaacttatccggtggagaggcacaaagactaaaacttgcatcggaaatggaacgcaaacaggatgcgtcggtgttcgtcttcgatgagccgacgattggtctgcatcctcttgatgtgcagactcttttgaaggtttttgaccgtctggtatccaagggtgcaacagtcattgtcattgagcatgatctggacgtgatccgcaatgctgattatatcattgatatgggaccaggaggcggagaagccggtggaagaatcattgcaaaaggaaccccggaggaaattgccagtgacagaggaagcataacggggaaatatcttcgatgatcagcattatgaaaagaccgacaatctcagaaagtgaggatgccggtcttttcctataattctaaaatctcttgaagctggaatctgccacaaagtttccggagattcttttccaccacgttttgcctaggtaatgagtgtgccagagatcatagatgaaagaagagtaggaaggcagtttgcttataataaaaaatgcggtaatgatatatatgacaaatcattggagtctgaaccaggtgtagtctttaaattcttttcagcttcccagcagtcaatgcgaagcatatagtctgcactggtataaacatcaatactgttacactgtggattgtattctgcaaatattgttctcatcgtatcttatctccttattgatcaataaatcatcagttacaaaaatcagaagcattttaatcagttcaccatgtcagttttattttgtgttatactgttttatatgatttttcttggtctccgctgccgcttcggtcggcacagagcagatgtccaccggacatcttgtgcccttgtattttcccttatcagagttcgtaagcactggcgggacgatgtaacacaagggaaacaataagggaaagttcacctgcgacaaatccagtgttttcaagtgtttgcagagaatttaataacaaaatataacagttattaaatctcttaaaacaggtgaaatctcaatcggaagttgaggaggtaaagagtgtatgaaaaagaaactgtgtattctggttattttaattgctgtgttattggtaggaacagtaggttgctatttcatgccaaaaaaattcggtaagaatgtaaatccttctgaggtagaccatataaatgtgttcgatggaaatacaggaactggttttactatcaccgattcagaagatatcgaatatatagtggcgaatattcaaggtatttcaatgaaaagagatggcatttcacttggaagaacaggatacagtttcaaaattagttatataaacagcaacgataaagatgtcatacctgtatttattctcaatagtgataatacaatttgtaaagatccatttttttatagatgtgatggcggattatgctttgattacttaaaagaatgtgaagagaaatatagaactaatgtaacagaatctatagaagaaaaataacatccagtttttgaaactaagaaatcggaattgaccgagctctttaaagcgagggacgcttcttgtccgaagggcaagaagatggagcatggaaagagttaaacaaatcgatatttatataggcattatagaatcagtctgtatgtggaggaaatcaaatgaactgggtaaatgtacagtataaaagtaatttgagaaaatacgaaaagaaggatggaatgaaagctcttgtaacatactgcttaataatgtgtagtgctttctttcaaggttggctttatacaacaaatgcaaatgtttttgttttaaatttatcgcagatattgattccattggttttaattgcagtattcttttgctttttttactgtagtaaagagaatattagaagtattggaattaattctgataatatcaaaaatagtatagtatttggtttagcgggaggtttcgtactacttgctatacagacggcattatatataatccaagggaaatcagtatcatttatcaatcctacattattaaattgggttatatttctatttgctgcttttgaagaagaaatactatttagagggtacatacagacaagactgtttggactcataaacggtcaatggattgttagtataattaattcagttctttttttatccatacattatcctgtaagatggatagtatctggagcaatatttatcaatgcattatcgacggtatacatagtatcgcttcttgtactacattttttttgcgatgctgtatataaaaggacaaattgcctatggggagcattcctgttacatgtaatctataatgcagtaggagcaatgattcaaatttcctaaagatggaacaatgcgataacttctggtttgtagaattaagaaaatcgggaatcaacaggacaaatgaaaggaataatattatggacgataatcaaaggatgaaaatcagaaatttcgggtatttaaaccaaggagcattaaaagggcaaattctttttacaggatcatccttgatggaaatgtttcctgtctgtgaaattgcacgaagccagggcatcgaacaagtgatatataatcgcggcgttagtggattgaatacagatgagtttctggaaaatatcgatacattgcttttagatcttgagccatcaaagatatttatcaatatcggcactaatgatattacaaaagaacgatttggagatcagtggatgtcacatttaatggataatatctgtagaatcatggaaattatcaaattccgtattccagatgtggaaatttttatcatggcgttttatcttgcaaatcttcacctgccatggcagacagaacaatcaatccaatggatgaaactccgtactcctgaaaatcttacattatgtaatcatcgattaaaagaaatagcagaaaaatacggttgtcgttatcttgattgtaatgaagcacttgttgatgaacatggtgaacagaaatcggagtatgccattgatggtgtacatatgtatgcaaatggatatttgaatgtttttaagtctttaaagccttatttgtaatgcatgaaagggttttattagtggaacaaaaagtaaacaaatcgttgtttatcaagctgtttaattttgaaaatttctttgaaaaactattgactcctacgtaacgtaatagtttagagtatgcttatcgagagaaggaaatgacaatgatgacggtgaatgaagtaagtaaattaacaggagtgagtatacgcactctgcagtattacgacaccattggactcttaaaacctattgaatatacagagtcaggttataggttgtatgacgatacatccttggaaaggctgcaacaaattttactgtttaaagaattggaatttccacttaaggagattaaaaagataatcgatgctcctaactttgacaggaacaaagcattagagcagcagattgcattgcttacgatgaaaaaggagcatcttgaaaatcttattagtttcgctcgaggaatcaaaggaataggagtgaaatatatggattttaaagtatttgatacaagaaagattgatgagtattctaaacgagcaaaagaacaatggggacaaacctctgagttcaaggagtttgaagagaaaacaaagaactggacgaaagatgacgaagctactgccgcaaatgagtttatgcaattatttgttgaatttggacaaatgaaggaaacaaacccggcagatgagcaggtgcagttgcaggtaaggaaacttcaggattacattacgaatcatttttatacatgttctgataagattttatgtggtcttggaagaatgtatgctggtggaggagaacttacggaaaatattgacaatgttggtggtacaggcactgcggagtttgcaagcaaagccatggatatattctatatgagcaggaaataaggaaaattttgccagagacaatgaagaagaaagcatgaaagctattctttataaagcgtttttatggcaaaacgagcatacagatatctgcaaaaacaataaaagtatttctggaataatattgtctctattaagtattcatggtacaatatccgaaaaatcggaattgtgaaagagtattgtaccatgaagatatatgaaaaaatatttgcaagacttaatgaactgcatatgagccagacagaactatccaaaagaaccggcattgctaccagtaccatcagtgactggcggaaaaagcagatcaatccccaggcagataaactatcggtaatatgtaaagcactggatatgtcccttgcggatttgctttgtgacaaagaaaatacagagcagacaacaccaacagattatttgattggtgataattatataatggaattattcagagaatccgacgccgataataagagaagaattcttaggtactttgaacttctggaaatctgcaatgaaatcaatgatagctgtccggcaaaaaagaggcagcgtaatgtatcaattattcaggatattgatgggaataacattgtagtgataaatgatatccgctttaaagggaaacggtcggttaactggaaagacgtaaaagagtatataaaagaatacgttggagatttttataaaatagcttctacgggagatgtgatatatattgggtctgatctccccagcgaatatagcggatcaaagtatacaaatagcctgaaaggagcaacctccaaggccaaggcaaatgctgcatccggcttaccggaaatgatagagattgctgtaggaaaacactttcgtataaatcaggaaatgaaacataagagagacgcaaaaaatggatggtacagatatgattccaggttcgcgcttcctgtgtatggaaatgacggggaaattgaaagatacaatgttttccatgcatctatgttaatacgtcattcaaatgacgagaaattgtatttgtacgacattatagatataaaaaaagaaacgagcaaccctctcggcgaataatcgcttaccagacaaaaaacccatttcctttatggatagataatactatatgatataaaaaatgtcaatccgaatattcgaaataatggtttggattagaaaccggtttttattctgcctgtcataaaatgaaaggtcattaaataaattccagttgatatttcacatattttaggaaatttaataactgttatatttgattatcaaattcttcgcaaacccttgaaaatactaagtttgtagcaagtgaactttcccttactctttcccttgtgttacattttcccattgcttttcatgaaccttaatatgggaaaaattaagggaaagaaaatttcataacacaatataacatataacaataacgacatggtgaactgattgaaatgttttcgatatttaactctgtaactgattatcaaaagaaaatggagataagatacgatgagaacaatttatgcagaatataatataaaccacgatagtattgatgtttacacaagtgctggatatatgcttcgcattgattgctgggaagctgaaaaaaatttaaaaaccacatatggatcagaatgtgcgcttacttcattggctgtggatgagcctttggaatatgcaagattatatcttgatggcaatttacagatgtgggtggatacagaagattcattagaactttattaagcaagaagtgagatagtgttgtagggagtttcctgtagttaaagataccacacccgatatgatgaacccacgcttatacactaccagctatgataaaagaaaggacagcaatttgacactgctgtcctttcttttataaaattgcagtacacagaaaaaagctgtaaaatgaaaaatatatttgtccttgtaacaattctcggacatttgcctgttatactatctgcaaaaagaaaaggaagtgataatatgaagcatattttaattgtcgaagatgataatcttttgaataaaacgcttacttataatttggaattggacggttacacaataacttctgttctgaatgcaaggacagccgctgaatcattaaaaacaaacatttttgatttggtattgctggatataaatttaccagacggaaatggttatgacctatgccgtcttatcaagccagagcatcctgatacagtagttatatttctaactgccaacgatcaggaaagcaatcagatacggggatatgaagctggtgcagtggattatatcacgaaacctttttcgattagtgctttgcagcgaaaaatcaaagccatgttcgctatgttggagcatcacaaaccagctaaggatatttacgaggatggtagcttgtttctggatttttcggaacaatttgcaagtttgaacgggaaaccattagcactttctgcgatggaatataaaatgttgaacctatttcttaaaaatccgaagcaggtacttactcgccaacaatttttagaaaaactgtgggatgttgatgaaaaatatgtagatgaacatacccttactacttctatcagccgtattcgcagtaagattgaagcggatggcgacacatatatcaaaacggtttatggtatggggtatcaatggacaggaggcgaaaagaaatgaatctgaataacctttctgctaagaaaatttgtagactggttagtgctggcatggttttctctatgctggtaattaccggtattttcggcggtataatgcaggatatacgaatttttatagtgggtggaacattgacactctgtgcgtttttctggatttggctattggtgctgatttttggaaaacgcctttctcattttacttctaatttgtgccggacgctggacaacatgattgatggaaacgaggaattacaaaagtcaaatgatagtgaaactctttttgcccgtatcaaccaccgcttaattcggttgtatgagattatgcagaaaaaccggcacaaggtagacatggaacgacaggagcttcaaatgctgatttctgatatttcacatcaagttaaaacgcctgtcagcaatttgcaaatggtaacggacacacttttaacaaagcctgtttcagaagaagaacggatggactttttacaaggcatacgtagtcagactgataaactggattttctgttccaagcactggttaaaacgtcccggttggaaaccggagcaatacgattagaaaagaaagacagcagcttattccatacgcttgcacaagccatgagcagtattgtatatgccgcagagaaaaaagaaattgctgtatccgtggattgcccggaaaatttgataatctcccatgacagcaagtggacaagcgaagcccttttcaatctgctggacaatgcagtaaaatacactccgtcaggtggaaagatttctgtatcagtggttcagtgggaaatgtacgtagaggtcaaagtgaccgacaccggcaagggcatttcagaaagcaatcaggctgccatcttccggcgcttctatcgtgaggaagaagtacacgatcaacagggtgtgggaataggtttgtatttggctcgtgagattgtaacaaggcaagggggctatatcaaggttgtttcagagctgaggcaaggctcagaattttctattatgcttcctgtaaggtaagatataaccactttttttgaaatgtccgagcgttgtaacatttcactctgattttcgataaaaattttttctatctcggacatttgtgtaacatttgtggtttacaatggctttatcaacagatagaaagccttgaaaggagcatttgaatatgagcattttacaaacaatcgacttaaagaagtattacggcacagaaccaaatattactcgtgcccttaatggtgtaaattttactgtggaacagggagaatttgttgccgtagttggaacttccggcagcggtaagtctacattgcttcacatgatgggaggacttgatacccccacttccggcagcgtgattgtacggggagaagaactcgcaaaaaagaatgatgatgaattgacaattttccgccgtcgtaacatcggatttatcttccaaaattataatctggttccgattttgaatgtatatgaaaatatcgtcctgcctgtggaactggatggcgatacagtagaccagaaatttatggacgaagttgtgtatatgttggctttagaagataaactggaaaatatgccgaacaatctttcaggcggtcaacagcaacgtgtagcgattgcacgagctttaattacgaagcctgcgattatccttgctgatgaaccgaccggaaatcttgatagcaagaccagtgcagatgtgttagggcttttgaagcataccagcggagaatttaatcagaccattgtaatgattactcacaacaacgagatcgctcaactcgcagaccgcattgtacggattgaagatggtaaaattgttggctaaaggaggtgggaattatgaattatccttttgaaaatgataccagtgcagtaattaaaaaattagcacgaaaaagtgtgcgttttgataagaagaaaaacttattttgcctttcggcaattattgtagccgttgctatgataatgatgtcgttgctcacagtgcaaaatatcatttatcaaaatcagaaagaaatcgaaggattacatcaagggattttctttgacattacgcaggacagtaaagaaaagttgttagcaaacgaagaagtaaaaagtgtaggactttcctgtaatatcaaaacagtgaaagaaaattctaaagaactgtctctgatttattatgatgatgacatgcttagtttgattcctgcctttgacggaaaatatccagagaaagcaagtgaaattgctgttacagatgccttttttgccagtgaaaataagtctccggaaatcaacgccatagttcagttgaatctggatggtactttgaagaattatactattgttggtatttatcatgataaaacttctaccgcttatcctgtttttgtttcacttgaaaaatgccgggaattacgtggaaataacctgcttaatggatatgtttggcttgaaaatgcagatacccttacaaaagacgaagcaacagaaatattatctcaaatttcagaggagactggactgaataattggacagtcagcagttactatgattatgtaaatacaactttgtccttcagtaattatgcggtatatggtgtagttgctgccattttgtttttagctgccgcacttgtaatttacagcattttctatatttcggttggacaaaaagttgctgagttcggacagcttcggacaataggggcaagtaaaaagcaaatttataaaatagttcttaaacagggttatatgcttgcagttccggggattttaattggtagtatcatgggaacgatcatcagctattgtctgcaatcaaaaggctggtcagtatttgcatttattgtttctctatgtggcgcatgcctttttggaatactgcttgtttatattagtgttcgtaaaccagcaaaaattgcagcgaatacttctccaatttccgccctgaaaaatccagtgggaattgtaaattaccgcactcacaaaagacatcgtattacgcctgtatatttagcgaaaatcagcttttccagaaacagaaaaaaatctctattgaccattttatcattgggactgtgcggagttatatttttccttgcagcaagttatcagagttcttttaatgccgagagtatggctcgttattgggatatgaagtacggagatttcaaaatcagcattgatttagaaaacgaaagtgaaaatttggatgctctcttgcagaaagaatatttttctgattatgtaaagcgtgttggagatatagagggagttagcaatatatttacttatgctaccgtaccagttgatttctcaacagacaatgatatttcagatagcaccttgatgctcggctataatgaaaaggatttggcgtcgctaaatgcagcggttttgtctggaaatattactgatgatacagaattagttgtaagtgatcccgaacgtatttatgatgtttaccattggaaacctcaaattggggatactgtgacctttaatttcaaaaatcatagtggtaaaacaataacaaaagcattcaaaattggtgcaatcacttccagcaatgatggaatgggtggctatattttcagaatgccggaaaatatgctcaaagaacttgcaggttatgactgtacatacgcaatcgaaatacaagcagaagctgaatatcaggagataatcgagcaagaactcaaattactcgtttctgacaatagggatgttcgcttacaaacccttcaagattttattgtagaacaccaatcagacaatcgtgcaggttttacattagcttatgcgattgcagccatcttgtggatatttgcggtcatcaatcaaatcaatcttactgtgacaaatcttttatcacagaaacaggaaatgggcacactaaaatctattggtatgacaaataagcagttgaagcaagcatttatgatggaaggtctttttactactttgattgcattgcttataactgctgttgttggaatccccggcggatatgcaatcggtatatttttgaaaaatgcaggcatgtctacgggatttgtatttccggttgttgcttttactctttttgctgttgctatgtttatgcttgaaagtttgatgacaatattgcttattcattcatggaagaagcaatctgttattgcaataatgcgaaattgatgatagaaagcttttcatatctcggtcagctccacaattacattactctgctgatacagccagtccgtaaattctttcgggctggctgttcctgtttttacagccttttttctctgtaatacttcttttcatacagtaaattttcactaggctggtatggagtaattttactgtctatacagtaagttgaaaatactaatatggtcttttttctaaccaaactttaagataacatctaattccaacatatgcgccctgcgaaagtacgaaaagcaatagaagatttactgacagtacttttttgattgattctccaaaataaatgacaatagcaacacttgtcagtatcattagtagagtaataacatcccaacagtttttcttatataattctataacctttatttctatcagtatcgccagcatccctgttcctgccatacatattcctacaatcaatattagcaataaccaatataccattccggctataaaagcatttggaatttttgtactaatctgtgccgcagaatgcccggcatcaatcgtccatccgacaaaggtttgtatgaatgatgctaaatcattgaagaatgatttacaatcgacaaggaacatatctgactgtactgcctgaaaaagagtggttgtcaacgaataccatgcaagaaggaacaaggttgtttggaacattaccgtttttgctttatactgtcctgcaagtcgctctttttgtgtttcgtattttgcttttgcattctgataggctgtccggttacaggcttcacatttttcatagagtaccggcttttctaccggtatttctacgattttctgatgtgtccgggcataatcccgttcctgtgttaaatagcatattttatcttgacattcctctatcatgacgtttgcgcttcgcaacttctctttctcgatccgcaatgctctgtctgccagcttcaagtcgttctttaatgcttgaatattcccggctctgttctctttgtttaatttctcgttcaaggtcagagattcgttgagctgcgtcttcagttccacgataagctggtctttctgttccaactcttcttgtatctcctcggtcaagagcagaagttcttccaactgttcggcgttctttaattctctggattcgttcatctatatcacgtcctttctctacctgctgttccagttcagcaattcggtgttctgtttcagtaataaactgttttcgctgttcagcttctgtgccaatatctgccattgctgattttcgttttccaaaagttctatcttcgttttctgttcttccatcttggaaagtagttcctcggtatttggcaaaatgttgagcagctcggataactcgctgtttaatttttgcaatttctgattctgttcctgcataagagagagttgggtgtcccggttctgcatttccagaagcatttctgccattaaggtctgctgttcttcgatttgcccaatcatggactccattaagggtataatttcccggctttcttctaatgtcatttaatcgctccttccataatgataatgcacctgatactttcccaaaggtgtccagtatcttttgcaataacgtgttttgttgttttatgatttgattttccgctactttccacgaaccttttatttcctgcccggcaagaaacttttgttcaatctttcttgcgtcagcaccttcatggatggtaggaatctggagttttccctgcttttcgtaagaacggtgatcgacctgattatgcaaaggcagatgttcattacacacctttgcccactcgctccgccacagttcacagttttttggattgttccatcccgtagcatcggtcagtacccgtttccattgcaggcggtttcttgcaccaatcttctggattccgttttcatctaatacagggatacggattccatgacggtcagggtttttcttatcctgccaccagttcggatgggattcatcaatcacgatatttccgcttttatctctgacaaaatcccaatctttgacttctttcttcccccaagaatgatccgggttaaaagggcgcattgtcagaagcagatggacatgaggattgccatcccctttgtcgtggatactccaatcagcacacattcccttatccacaaatgtttttttgatatagtcggctgtatattgaatctgttcctgtctgctccattctttggggagggcaaattcaaatgacctgccaagttgggcatctgcacttttttcaatcttcaatacctcattccataaccgttgtttctgaaatgtgattttaaatttttctaaagcagcttctttatcttctgaccttttgtatcggacagatttttgaaagcgttttatattttcttctggtactatctgccattcaggaggtgcgttttcgcacatcatcagactggtgtagaccacttcttttttagaagtgtaataactgattcgcccggtttcctcgtttttcatcacatccccattgagatatgcggaagcggagataacagatttccctttacttcgtccgactattttgattgtgtaatgaaaaatcgccatgtctggattccccctttctgcacatccggcatagatttccggcaacattgctttcagttttagaaaaagcagtattgccggaacgccctctgcgtaagagtgccctgcgcatagcagcctgcatggaatgcgcccctctggcgaagagtgcctcctgcggcatgagcaggtctggctgaaagccccgccgacggaacgagcccggcaagcgtgagcgaagaccggttgccacttgtggcaaacttattgggacgacctctggttgtccataagtgcgcccttcatgaaaaagcaatgaagggaatgaaaaactcatcccccccgccattacacttcctccatatcggtatgtgtttctttctgcattgcctttgaaaaaaatttcccattggcttcctgctttttcagaaaaccaatcagctttgggatgtcctcttcctcgataggcgcaccgagaacggattccaccgcaccgccaacctgacagagcctatgggttcgttttttactttcttcggctttctttcgtttcagaagttctttcttctgtgctgcatatcgttttgctttttcaaggctttcctgttccttcttttccatttcaagcattcgttcttcataactttttgttgattttgccatgattacattcccctttcttttacaaacataagttctcggttgcgtatcagaagaagcacatggtataatcttcttgcgtgtaggtatatcatggcttcggtctgatagaacctttggcggtttctttggaagccgcctttttaatttgccgcagttcttgttacggcttttacatttcctctatccctcaaatcacgaccttcattcgcttccataaacatttccagaatatcggttttaatcaggactttgcgaccaacctttaatactggaagtttcttccattctacaagctgtcttaaggtgtttctgccgattcccgtatagtcagcagcttcttcgatggataatgcaatttttctttgcgtcatataatcacctccttataaattgcattatgcaattcttgtgatgtaagtatatccttttcatatctttttgtcaagcgttacgaaatattaaaaataatttttaagttgcatattgcaattacagaaaaacaatgctataattcatacataccgaaaaaggaggcagtcagcatgaaagataaagaactacgcaagctgataggcagcagagtaaaacagcgccgtctggaattgaatctgacacagccttatgtcgcagaaaagatgggtgttaccgcttctacaatcctgcgttatgagaatggttcgattgacaatacgaaaaaaatggtgctggaaggtctttcggaagcactccatgtatctgtggaatggctcaaaggggaaacagatgaatatgaaaccgacattacggataagagagagttacagattcgtgatgcgatgggagatattctggaacagttaccgcttgcccttaccaaagaagaagatgctttttcaaaagatttattactgctgatgttaaaacaatatggtctgtttttggattccttccagttcgcctgcaaaaacttcaaggggaatgctggtcagacggatattgccaaaacaatagggtttgaatcgaatgatgaatataatgagattatgttcttaagggaaatcactcacaccatcaatgcttttaatgagatggcagacgttgtaaggctctattccaagaaaccaaaaacagcagaacaaaggcttgcaaatcttttatcagaagtcttatacgaagattccgaatcggtatagtaagacaaccggagttatgatatacttacacgcacgaagcatttcatcagttccgattgtctaatatcgaaaggagacatacgattatggcaaaaggatctgtaagaaaaaaaggaaagaaatggtactaccgcttctatgtagaggacgcaagcggcaatcttgttcagaaagaatgcgttggaacagaaagcaaaagtgaaactgaaaagctgctccgtcaggcaatggatgattatgagaaaaagaaatttgttgccaaagcggaaaatctcacagtcggacagcttttggatgtgtgggcagaggaggaattaaaaacaggtacgctcagcaatggtacggtggagaattacctcggaacaatccgaaatatcaagaaacacccattggcagaacggaaactgaaaaatgtaacctctgaacatttgcaatccttcttcgatttgctttccttcgggggagttcatcccgacggaaaagagagaaagggttacagcaaagattatatccattctttttccgcagtcatgcagcagtccttccgttttgcagtatttccaaagcagtatattacgttcaatcccatgcagtatattaaactgcggtatcagacggatgaagtggatttgttttccgatgaggatatggacggaaatgtccaaccaatttcacgagaagattatgaaagattgcttgcttatctgcaaaaaaagaacccagccgcaatacttccaatccagatagcctattatgccgggcttcgtattggagaagcctgcggtttggcatggcaggacgtaaatctggaagaacaatgccttaccataagacgcagcatccgatatgatggctcaaagcgcaaatatatcatcggaccaaccaagcggaaaaaagtaagggttgttgattttggagatacactggtagagattttccgtaatgcccggaaagagcagttaaaaaatcgaatgcagtacggagaactttatcacacgaactactacaaagaggtcaaagagaaaaacagagtgtactacgaatattattgtttagacagaacagaggaagtcccgacagattataaagaaatttctttcgtctgtttaagaccggatggttgtttggaacttccaactactttggggactgtttgcagaaaggtggcaaaaacattagagggatttgaaggctttcatttccaccagttacgtcacacctatacaagcaaccttttagcaaatggagctgccccaaaagatgtgcaggaattgttgggacactcagatgtcagtaccacaatgaacgtctatgctcactccacaagagatgcgaaacgaaaatcagttcggcttcttgataaagtggtgggcaatgactaaaaaatttcccttatttcccttgtgattatctcataagggcaaaaataagggaaactacatatcatttcactaatggacaggcgggaaagcctataaaatggggaaagttagaggaataattatataaattccagttgtagataatgcaaaaagaaaaattgaatttgtaaagaaatcagcaggagctgaaaaaaggaatcgagaaatcggttctttttttagtttgcgcgccatgggcgctctgacgggtgcaagtcccgaacgcgcccagatagtgggaagcgggtggcaggattatggggaaaacggtatttatgaatgcactttccgtgatattgaaaactcggctacaggcggcaaaaaatgaatatttctttaattttggaatcatactatttacattaatgaaagactaaggtaatcttttgaaaagtattcacagagtacgaataataagaaatgaggtagattgaagatgaagaaaaaaataattatgattgtggcttgcgtgatgtgctgtgctggattatttggcggctgtggacagtccgggatgaagcaggataatactgcaataagcaatagcgaagagggaaaacaggaaggaacaacagaagaaaaagaagtgaccggaacgattgatgagataaaagatttcatgtttgtcgttacagatgagaatgatacaccatatagctttacttttgaggaaaagccggaaggactggagaatgtcagcaacggagatactgtgactgtaagatataccggaacaatttcagaggtagatccgtttgagggagaggtaatatctgttgaaaaggcacaataaggccagaaaagcgactgaattactggcggttattatactcgcatctgcgatactgggagcctgtgcagaaaatgtacagaaacagaagatacctgccgcaacttatatgggcgggaaggcttccattaccgggatctgcagggaactggacgctgcaggagcttcccatgtagatttatttcaggagtgggtggtcgattttgcggattctgcggggaagaatgcaaagctggaggatgcctggtcagatcctgcgaagatgaaagcagatattgtaaaatgtatggatggctgggaacagaatcatgattattcagacgctgactgcaggatgacagcgttccttttgctggatgggatgctttgctcggagtcaacagaaagcaattatacaggcacatatttaatgtttgacacggaagcgatagataacgtggacagatatgaaatcataaaaaagaatagggatatgtttactacactctatggcgaaaagcgtgtaacagagggcaactctccggaaactgtgttttccgacagctggaaatatcatggatttcaaataaatagtgacaggatatctcttcttagtatcgtgatatatgacccgtattctgaggttgttttcgtagggcataccggcatactgataaagtacagtgactattatttatttgtagaaaagatcgcctttgaacagccctatcaggcgacaaaagtgcatactgtagatgaattgctcaatatcatgtcattaagagcggaatacttcggagaagagggggaagccggaccatttgtatataataatggagaatatattggaacgttaaagaaaaatattgacatggcagaaaaaataccctataatcgttctaaatagaacgattataggcggggttgagatgtatttctgggataaacataaaacaattacaggatattatgaactgttatccggcgaggtatgcgaccggtacgggttaacacagatggaatatgatatactgatgtttttacataacaatccacagcataataccgcagcagagattgtaaaggtgaggaaatcaacaaaatcccatgtatcaacttcactgaaaaaattggaaaatgaaggtctgattgaaagaatacaaagcgaagataataaaaagcatattgaaattgttttattagacaaggcagagttgattgtggaagccggaataaatgcacaaaaaaagttcgccaaaaatgtattaagcgggttgacagaagaagaaatacatatgtgtatcaatgtatttgataagatctgtaacaatgcagaagaacatttgagagactacagggagaatgcaaatgagaactaaattttgtgtaaagaaaaaacattactgttgattgcaggcattgtctggatgatagcaggagttatttttaccagaaattatttgttttacagccgattgatgaaaaaggggcaggactaacgatgaaagaaaacaattacaaaccacagatcccagatgtgatggaagcaatatttgatgcagcgtatttgacttttgatctggttgctgcaatgctttttttcatattttcaaagggaaatatgttatttattctttatggaatattaacattgacactttgcggaggggatgcttttcatctggtaccgagaattatcagggcagtacgtggaagtaatgataaaataaagcggcagctgggaatcggactgcaggtatcgtctgttacaatgacagtattttatattattttgatgtatatctggaagcttacatttccggaatttaaaataccggtggtaattgaagttgttgtatggatatcagcggttgtcagaattgtgatatgcctgttcccgcagaacaactggtgcacagatgaaggaaatatgagattatctattatcagaaatacagtttttgcagttactggtacagggataattattttatatttaatttcgggaaatacctatggatatcatatgacaaggatggctgcggctattattatttcatttggctgttatcttccagtaacgttattcagtaaaacaaaaccaaaagtaggactattaatgattccgaagacctgtgcatatatgtggattattgtaatgggactacagattttgtcggaatattaaaaatgagctgggaaatagcaaaatatctgatgtggctatgtagctggatttgtgataatttcagaaaagcacagaacaaaaagcttgcattttgaaaacaggcgtgtataataaagctgttataaaacagaccattacagaagtgataaggataatgaaaacggggtgctcgcacggcgggctgagagtaagcggatgctttaacccagaacctgatttggataatgccaacgtagggagataataagtcacaagagttatttgtgcaggaatctttgcgttgggttcctgcactttttttggccgtttgcgccgataaggcagcagtaagaaaaatgatatatcacagcggcagattgggggcaccaccttaggtcgctatataaaattaatgcagaggaggattttatgtacacagcattaacaatcgctggaagtgattccagtggaggcgccggcatccaggcagatattaagacaatgaccgccaactgcgtatacgcgatgagtgcggtcacggctttgactgcccagaatacgaccggcgtaacagatattatggaagtaactcccaaatttttggcagagcagctggacagtatttttacggatatttatccggatgcagtaaagaccggaatggtctcatccagtgaactgattgagacgattgcggacaaactgacagagtatcacgcaaaaaatattgtggtagatcctgtcatggtggcaacgagtggagcaaggcttatcagcgaggatgccatcggcacattgaaaagtaaattattgccccttgcaactgttatcactccgaatatcccggaagcagaagttctttccggaatggagattaaaacagaagcagatatggaaaaagcagcagaaatcatctgtaacaccttaggctgtgcagttttattaaagggaggacatcagttaaacgatgccaacgaccttcttttccagaaagaaaaagaaacggtatggtttcacgggaagagaattgacaaccccaatacccatggaacaggctgcacgctttcttcggcgattgcatcgaatcttgcaaagggaagggacttagaaacttccgtcaggtatgccaaaaattacatttccggcgcacttgccgccatgcttgaccttggaaaaggaagcggtcccatgaaccatgcatttgcagtcgaaggagagtacaaaggatgaataaaaagagaacttccgttttttcaaacggactaatctggtttggcgcaggcgtatctctggcggaaatactgacaggtacctattttgcaccgctcggtattggaaaagcaatggcagcaatcctgcttggtcatctgatcggcggtcttatgatgtttgcggcaggaatgatcggagcgaaagagcgcaaaagcgccatggaaactgtaaaaatgagcttcggcgagaagggaagccttctttttgccgtattaaatgtgttgcagcttgttggatggacggcgatcatgatctatgacggcgcacttgcagcggatggtgtgttacatattggaaactgggtgtgggcgctcgtcattggtgttctgattattgtctggattttcattgggctgaccaatctcggcaggctaaatacggttgccatgacagcactttttattttgtcactggtactatttaaagagatcttttttaattcagattttgtgatgctgattacagcaagtgatgacacaatgacgtttggtgcggcggtagaacttgcggtagcaatgccgctttcctggctgccgcttatcagcgattatacaagagaagcagaaaagccgtttgcagcaacacttgccagtgtgcttgtctacagtctggtcagcatttttatgtacatgatcggcatgggagcggctatttttaccggtgaatatgacattgcacagattatgttaaaaaccggttttggcgttgtcggacttcttattattgtattttccacggttacaaccacctttctggatgcttactccgcaggagtttccagtgtttccatttcttcaaagattcaggaaaaatgggcggcgatcgttgttaccgtgatcggaacggctgcagcgattgtgtatcccatggataacattacaaactttttatatctgatcggttctgtttttgctccgatgatcgcagtacagatcgcagattatttcattttaaagaaggcagatgccgaaaaatctgctttccagtggcgtaatctggtggtatggcttgccggttttatgatttaccgcatattgatgcaggtagatacaccggtcggaaatacactgccggatatggtgatcacagtcattctctgcctgattgtggaaaaagctgcgggggcatcacacaacaggaaaagaggatgaaaaatgaagaaactgaatttaaagaaattgacggtcacagcaatcttagcagcggtagcagtggtgggaagcttgttttccttcccggtattcggttccaaatgcgcaccggtacagcatctggtaaatgttttatgcgcggttaccgtaggaccatggtgggcgttggcacaggcttttattgcgtcgctgatccgtaatctgctgggactgggaagtccgctggcattcccgggaagcatgtgcggtgcattgcttggcggacttctttataagtacgggaagaaacttccgtttgcctatctcggcgaggtggcaggaaccggaatcattggcggaatgctttcttatccggtggcatatcttgtcatggggaataaagcagcggcgctatttacgtttgttgttccgttcctgattagtacctgcggtggaacactcattgctattattattacgctgccgctgaaaaaatcaggtctgcttggcagaatgaaggaaagtttagaagagtaaaaatgttaaggtgttgctgcatccgtattgcattgatgtatacgccggtcatggtatggagaagataggaaatatgcggttattgatcaaacagagagtgttttcgtggacagattcctatgacgtgtatgacgaggcggggagagcaccaggaagaggtcagtgcgtgggattgacaagcagatagaaattgacgtatactgaattggattttgaggaaaagaaaggaggacgcaggatgaacggtctgggttatgcaccggtctgcagcagcagtgcattgtcaaaaacagatatttttcgcgtgtacgggattactgcgcccttttttaagaaggtttagcgtttctgtacaaagaaaaatgcggcagtaattccgaaacagtttgatctcgcaaaggtgtgggatcgggctgttttttcattttattgataacaataaaaagaaaagaggaattacagatgaacgaaaaacagaatcttcgacttaagagaaatgttgggctggactatgtccatacgtttctttccaatatgaacatgcaaagctcgatctgggtgctgtatctcgcatattgcgggatgcacctggcacagatcggactactggagggaatttaccatgcgacaagcattgtgtgtgagattccttccggggctgcagccgatctgttgggcagaaaacgttgcatgattttgagcaacatctgcatcgcggtttcctgcgtgatcatgctgttctcaaaaagtttcgggtgttttgcggtaagctttgtcgtacaggcacttggaaataatttaaactccggctcggaggaagcgcttgtatatgacagcatgaagtgcctggggcaggaagaacactacatgggtgtctatggaagactcaatgtgctgatcgaagtggcgcaggggcttgcgacggtcgccggcggtgcgctggcagaattctcctatttctggtgctatgcggcatgtgttgtgattgcggtgctggcattgctgccggtactgtggatggcggagccgacgcagtgcggtgaggcagctgatacggccggggagggtgtggaagatgcggcggaaggaactccggcacagagaacgatccgggagaccgtgaagcatcattttgcagtcagtgcgtgtatcctgcaaaaggatgtcagaatcggaaaaatcatcggcttctattctgtcgtttttgcggcgcacacgctgctgtttttctacagccagcaatatttcgcggatctcggttacaataaagtgcagatcagtgttattatgctgctcgtgggaggcgcttcctgccttggtgctctcgtcagtgaaaaaatgtaccggtggtttgggaaaaagtgcctgataccggagacggttatcattgcgggggcaatactctgctacggagcagggaaggcgggcgtggcgatagcggctcttatgtgtgccggatttgcgaacgcggcgttgtatccgatccagtcggactccctgaacgcactgattccgtcagagcagagggcaaccttgatctcggtcgacagcatgtgcttttccatcgtcatgattgtgctgttcccgctggcgggagcacttgcagaccggtgggggttaaagacggttttactgttgctcggcgtcattttactactgtttcttttgacagtcttttgcatcgaaaaagaaagcttttcaagcgatcattcctgatgtatgatgaaaaaagcgaggtaagcatatgttaaaattagagaagggacgtcctgccgactgcgcgggacgtctggaaaaagaagtccggacgtacgattttctggataaactgaatatcgaatatgagcgcatcgaccacgaggcggcaatgacgatggaagagtgtgcagatgtcgacgaagcgctcggcgcaatgatctgcaagaatctgttcctgtgcaaccggcaggagacaacattttacctgctgatgataccgggagataagaagtttaagacaaaggatctgtcggcacagatccattcgtcgcgcctgtcttttgcaaaagagacgtatatggaggagtttttagacatcacgcccgggtcggtcagtgtgctcggtctgatgaacgacagggaacaccgtgtccagcttctggtggaccgggatgtgctgaaaggcgactacatcgggtgccatccgtgcatcaacacgtccagccttcgcataagacagaaagacatgtgggaaaaaattgttccggcgctggaacacgaaccggtctttgtgacattggaagaaccacaggagtgagcagatatgaaaaagaaaatgcagataaataagaagaaagaagaacggcggggaacgcaggaaaaaatgttggaaccggcaaagtcggcaaagtcggcaaaggcggcaaacacgggaaagcagacaaaatcggaaaaatcgtcgaaaccggcaaaatcgtcgagaccggcaaaactgaataagccggcggagcgcgcagatgcggtctgtccttacgcgaagaaatgcggtggatgtgactatcaaggcatgccgtatgagaagcagctcaaggagaagcaggcatatgtgcaaaagcaggtcggatcattctgcaaagtgctgccgattctggggatggacgagccgtatcattatcggaacaaggtgcacgccgtatttgatattgaaaaaaagcgtggcagtcgtcccggcgttcgtgggaacggtaaagccgcaaacggaaaacagggaaacggcaaaaagggaagattagcggcaaagccggcaccgggagggatcatttcgggtgtatacaaagcgggaacgcatgaggtcatcaatatcgatgcctgtcagatcgaggatgagctgtccggcgcgatcatccgtgatatccgggggcttttgcattcttttaaaattaagacatacgatgaggacaccggttacggtctgctgcgccatgtgctggtgcgccgcgggttccacagcggggaggtgatggttgtcctggtgcttggctcgccggtactgccatcgaagaatcattttgtgatggcgctgcgggaacttcacccggagatttcgaccgtgatcgtcaacgtgaacgacaagcgcaccagcatggtgctgggcgacaaggagagtgtgatctacggtaagggctacattgaggatacgctctgtggatgcaccttccgcatttcgccgaagtcgttttaccaggtcaatccggtgcagacagagctcctctacggaaaagccattgcatatgcggcgctgaccggaaacgagacggttgtggatgcgtactgcggcaccggcacgattggcattattgccgcgaaatcagcgaagaaagtgatcggtgtagaattaaaccgcgatgccgtgcgcgatgcggtgaaaaatgcgaagtgtaacaacgtcaaaaatatcgaattttacaacgcagacgcgggacagttcatggtagagatggcggaataccgcgcggatgcgaagcgcggagagaagagcggagcagacgaggtggatgtcgtcttcatggatccgccgcgcgccggaagcgatgaggcgttcctctcctcggtggtgacgctggcaccgaagcgtgtcgtttacgtttcctgcaatccggagacgctggcgcgggatcttttgtatctcacaaagcatggctaccgggcacaggagtgccagccggtggatatgttcccgtggacgaaacacgttgagacagttgttcttttgtcccaacagaagccggatgacacgatagagatcgacttagacctggacgagctggatgctaccagtgccgagttgaaagcaacctatcaggaaatcaaagattatgtgctgaaagaatttggcttgaaggtttcaagtttatatatttctcaggtaaaacgcaaatgtggaattgaagtgggagaaaactataatcttccaaaatcagaaaatgcaagagttccacaatgcccgaaagagaaggaagaagctatcaaggctgccctgaaatattttgcgatgatctaaggacatcgctgatttcaaggaggaataacacatgaaaagcacatttgaaaaaatgggtggaacctacacacttggcgcagacggaatttactatccgaatcttgtcagtacagatgaagaaccgcattatgggaaatatggaatgatgcggaaaacatatctgaaagagcatcgtctggcaatgtattcactgtatatgttggaagacagactggtggaacatctgaatcttgtggacgatgaagcacaggagagaatggatattctggtacgtcagatgatggagcagcagggcattacggaagaattgaaagctcgtgatcagatggaatgggtcagagcggtaaacaatatccggaatgctgcagaagagattgtgttaaaagaattagtgtatatttaaggtaatggaaagctccttcgggagcttttcgctgtttggaagagattatatagaaaatgggttaagaagatggtattattaaagcaacgggatttttttattatagtatctaaaatgttttattcattacaaggaaatggaattgatgaatgccattaaacttcctaatagaaatagaatcgttcgatattctgaattggaaaatttgataagtacagattagagcacgtgtagatgtaataagagaacgaaaggaaaaatatgggaaaaagcacaaagaagaaaaacaaaaagattacagctccaaaagcaaatattcaggaattaagtatttctagggatggcggacaaattgcactcagggggtattcatatcaatttttgtattcgtgttatttaattctttcgtcatcaaatccaagcaattttttccagcttgaggggattgaagatattgattgtatcatgcagaaaaatggtagtaatgatattactcatatacagttgaaatattctgtcaacaaacaggatgccagctttttaactgatgtgctcaaaaattttcttgaagcatatttgctggatcaaaatagattttttaagcttgtttacgatttccctgttgcaaaaggccatctaagtaagatatttgcatctaagttagacgaaaaatcacgcacccattgggctggcgtgatttcaaatatcaagaaaaacaatccttcttggaattggtctgtttatgatttcgataaatttatttcacatctgtcatttgagaagattgaaaaatctatacttgctactgaaattgaaaaaaccttaattagaatttatgagattaacacagacaatgtttcattatttgcaaatagcataaaaattctttgctttgaaaaaatggagcagcgggcctatgtgacaaaagcagaattagattccaaaatccaatctgtcaaaatagatatcagtaagggtcctcaaaatccagctcatagttggattcgtaaactggactactctaagcctagcattgatgaagggtgtagtttttacgaagggaaaaaagcaacaccagcagatatagtaagtgggtttccaatcaaacgaccgagtttagaaaaagatgttattaattctatttgcgaaaacatggttactgtaattaaagcttctagtgggcaaggaaaaaccacgctggctttgcgggcagcttatattctccaaaatgaatatataccatatcagttactatggtgtgatgagataaaagaaattgggaatattgtccaatatttcaaagcaagaattcagcttggtgaaaagattcttatcttaattgacaatctggataaccatctcagcaaatggaattatcttgttcagctcttacaatccgaattgcattgtcattataagttgctcatcacatcgcgagagatggattggtataattatagtggtgacttgagcaatatccagtctttgaaagtaattaagccggttttagaagaaaaggaagcaatagagatattcaatctattcagagaggctaagcaacttcacccaagcataacaagctggcaaagagcatggaataagattgcagaaaggcaactacttatagagtatgtctacttgcttactcatggtgagatgttatcagaaagaatagcctcacaaatatccgaaataggacaatcatcttctggcaaagcaaaatgtgaaatcttacgcaaagtatgttttgcagatctttgcggagtcaggctttctgctatcaaactttctgcgagtcaatcagaagactctggctcggattttggggagcttttaaaaggtatggaatcggagttccttgtgcatgtaaatgaagagagtgggtatattgaggggctacatcccattcggtcaaagcacgttgttaagaggctgcatgaattcctgccaattgacaataccgccatttcagttatgaaaatggcggacaaagcggacctatcgatactgttttctcatctgccggagtttaccctgaacaaagaaacgtttttccgcgatgcggtcgagagtctatgggatgaaaaagacctttcaaactatacttctgcaatacaggggcttttttcagggagtgtgatgcagtatttcctttctaaccgggctgcgtttgacgatgcagatgcccacggcggtctttttcttctatcgaccgaaatgtgcccctttgctgtattcgaggatttcggtgtgtcgatggatacgctggacaaaatgcgggaaacatttccggataataagaatatagaatatctttgccgattacgggagcgtattcccacctgctgtttgcaggaaacgtatgtctatattttctgcgattgtttatataggaaaatgcgcacctttcgttttgacggaataaaggacatcacgtcctatacctccatttctgagtggatctataacatcaatccagagtggaatgtatcggccggattttctctggacgatctttggagcaagccagaaaaattgacgctggagtgcgtttctacgctgatgtatctctcctactgcgggaacagagagaaatatatggaatttgtggaacgaaatcttaagagtattcttacgtaccttaagcagtggaccagatcacatagggtatttattgattccgaaaaaaaagcgattcacattgaatatatccttcgattgcacaatattaaaacgggaaatgagcagagcgtctcaaggctgaaattcctttgtaaagccttgcctatttttgatttgtattgcgcggatgctctcaagccgacagttgatttgctctcggcttatcctgttcccgacgatgcacataaagaaatgcccattaaaaatattgtaatcatgttccatcagaatcttacgtcgctatggaacaagaccattatgagcaattacgaatttgataccgcgacagaatggttaaattactggtttgatgtgagagaacatatatgtttgcttgcagataagtgctgtgcctgtatttacaaactccttggcggaaaaccattagggagtttggccggggaggtagatcaacttcgtgaagaatttgccctaattactactggtgaaaagcgatatcctaaagaagatcgtccttttgaagaaaaagctacagtgcccgagaggttaggaaaaataaagagtaaatactttcaaagcatacaaaactttatgaatcagtttgcagggttcctcattaagaatgaacaaaaacaaagattggctatggttaacctcacaatagctcaaagtgctcttgtgacaatgcagaattactttgcagaaattgcaattgattttagctttcaggaaagacagttgactatttgtgttatggaaacacaaaacatagagcgactaataatgtgctgtagctactaccagacacattcgccaaataagtattttaataaatatcaaattagcaattggtatgacgggcattgtcgggatgagagaaagatagtagaagacggattgtcggaattagaatcaaagtattcgattcattttcctgatcagatttacaccattgacatgttgagctattatcccatcatagttggtaattttgatatggcatcggaaagcaatttaaccgaatggcttctgggctgtatcgcatttgctgatgctccctttgattacctagtcatattatctgcaaacgagtccaaagaaatagattctactgctttacagttccctcgacggatgctcgttgacgtcaagaaggcaatcgaatcagaaaatcattcattgcttgataaactggtgcctccatatcctgtgaatgtgacagcacaaatgcttgactgctttagtgaaaaatatgatttgcctgaaaaaaaagtcaccgatgtcgatgaacttccaataggatatattgcagaagaactatggatatattctaaatctgtggagttgttgacggaaccagaagatgcgtgttatcttgcagctcaaacgcaagatattcagctcaacattacggaaatgctttgtttattgaagaacaagcttccggtcaaagatgtcgattggttaatagaaatttgtgataacgtattttcaggagaaaaatttgatgacattatgttcaataatgttattgaacatttcatacagaaaaagattgaacagtaaaatcgttgtagcttgattgttttagcagacagtgtctatttaatcgaagaaaaagaatgttgatagtataggcattgaaaatgctagactatgacttagatttcaaataaaagtaaatagttggaatattaaaataataatgtgtgaatattattcattgtctcggcaccatttatggtgccaggacaatactttagatgattacaattccatatcatgtgaccttttcttagtccgagcagactgatttcgccgcatttcctgttctctctgatatttaagttcccatgcacgatgggagaaaacatcaggatcctccacattgagataatccacctcattggcggcaatatcacgacggtgatagtcgtaatatttaccgaaagtacctttgagttgttcaatcagcttatcccgaaaatcaggacgtatctggattctggtatccagcaattctgtgtactgttctggttcaggacgaaatttttcttcccggaaagcggcggcatctttttcaagctgttttttgagcgagatgtcctgagaatccaggatatccagattgttattcatctggtcatattttttggatagattcgtcatatctttatcggtagagcattctgcttggaagattagctgctctttccttgatttcagttcttcgatttcttcggtaatagtggtaagctgctgattcaattttatatgctggatgggattcaaaatactggttttctcttttttcacattcagttctttccgctctgtaactttagctttgagtttctttttaacggtgttgtatttattcagtattggattaaaatgattcatccagtcatggatcacttctttttgcatctcattgtggagcaaatgatattgtgtaaaaatcatgtgatttcggattgcttccaatgtttctgcaattattggaatagacttttctacagcttcagccagttttgctacttttgcttttaattctcggagcattttgttatccgcacgaatctgacggttgatttcacagcggtctgctatcatgcctttcttttccatattctgggcaatgtagccttcatggatggttggctgttcggtgattccctgatctgcaaagctgcggtgatcaatggtagcatttatctgattacgtgcaagcatttcatttacggcatctgcccagtttgcccgccagatgcaaagttgttcatcactgttccattgttcggaaataggattctgtctgccatatcggctgctcttggggtgtttatcattccgttcatatcctttttcctgtgcaacagaggaagtcagatattctttctttttcccaactttatagcgatattgcttttcccatccctgtttctgagcagttttaaattcagaagcagtaaatcctttttcttctccatctttgatacagagatattctttttcggttttatactgccatgttccattttcatttagtggtcggacagtaagaagaatgtgtgcatggggattgtgaccatctgtattgtgaatggcaaaatcagcacacatccccatatctacaaaattctttttaataaaatcctgaagaagagaaatattgctgtctttatccaactcaacggggagtgcgacaacaaattctcttgcaagtcggctgtctttggtcttttcgttttcttccacagcattccagagttgttcccggtcattccattccaatggagccattggaggaagcatcacctcctgatagatcagcccctgctttctggtatagtcatgctggatgccgtcataatcattgtacatgcggctacagctcatataagcagaagcagcaacagcagatcgaccggaaccacggctgacgactttggcttgcatatgataaattgccatatctggcacctcctttcgatgttgcctgcaacagcggataaagccctcggcagagcgcacgagccccgaaggggataccactgcctgatttatcaggtggtgagtaagtgcgcccttcgggagtggaacttgtgcgtttacattccccgtagccggatcatcagctcccgtttcagggaatctaaatccatttctttaatatggggaacaatactttccagaattgctccttcctggactaacctgtgtgttctggcatcacgttcttttttgcgatttcttgcttcggcttcttcctggcggtgtcttgcctgtaaaagtgctttttcttccggtgtcatgatttttttatctgccatatctggcacctcctttttatgcccgtatccgggcagttttggttttaaaatcttttggtttggtactatggttttagataactgacagtgacatatttccggtaataaatgaggaaagaaagtagtaccactgtcagtgaaaagtaatcattgtgttatactttttcgagtcaattctggttcggagcatgattgttcaacaggatttttttcgcctgttttaaattagctgttgcattgtcctgacgaatattccggttattgatacggacaggaatacatctctccagaatacggtcataaattcgtttgtgtgcgatatcagcggcgttattcagttctgataaagtgagattggtcgttatgatcaggggctttttactgcggtaacgactgtcgatcacattgaatacctgttccagtgcaaagtcagagttccgctcaattccgagatcatcaataatcagaagactgtagcggtttaagctgttgatgaactggtttctgtcttcaaaatgcattccggtaagggtattcagaattcgggaaaagttggtcatcagtacaggaacgcctttttccagaagggcattggcaatgcagcctgcaaaaaaagattttccagtaccgacatcaccccagatgagaagtccggaagcgtttgctttcatctcttcccagttgcttacataattgtgtgccagttttatttccggattgatgccgttatccctggcaaaagtgtagtcatagagtgctttgtcctgtaagccgctggttttaagatgctctatttccatttgtttttcatgaagttttctctgggcttcttcctgctcaaagatttcctgctggcatttacagcggatggaaggaataagaacctttccctgtaatttatgcctgcattgccttggcgtattgcatttagaacagtagatcaggtggtctgtttcgttaaaatattcatcaggctgaagctctctgtttggtgttatagcggttgcttttcctgtaaatcttgtcatagtgtttcgtattcctcactttcgtaatttctttgccgggaagcaggatgatcctgtcttgcccaactgatgatggtagctgcatggttctgatattgttttccggtagaagccatataaccggataagcgttcaatataatctttccagtcagggattgtctgccggatatcttcaagctctttttctgacagaaaaacattttgaaattttccatagggtgagagtggctccttactccctcttattgctaaattgttcttttttatctctttcttattaccagacagttttctgtctgtatcagggaaagaatcctgtctgtcaataggacagttttctgtctgtcttagggaaagaaatctgtctgtatagtggatggtttcttttgggagttttacataaattcgattgggctgtccgggtccctgccgttttcggaagataagctcctgtttttccagtactgccagagcagttttaatcgtcatctggcttttgtggagaacttctgccagtgcttcaattgtaaagtaaatgaacacatgaccatcgatatctgaccagccctcatttttctgggaaagccttgcccggtcgagcaggataatataaagcattttggcagtttcgtttatttccatgtccagaaggaaacggggaaacatcatataagatggcaggttggtgtctgctgtcagaaagtccgtcatgtgttcacctccaatcagttattctccaagaaaatcccagtctacatcattatccggctgtgaattttcaggtgttggaaaggacgccctgatttggggctccctttgcgccatgcctacagtcagtccggaaagaaaaagtggcaattcctgtttcagactgttttccactgcatctacaatctgtttcacaaaaagttcttcccgttctcttgtttccagataagaatcagcctgtgtgcggtagtagcggtcaaaataatctaccagtgcaagagagattacctgactgtaagatttaaaatcctgcctgtccatcgtctgtaaatattcccaggctctccgctgttgttctttgtccagattaaagcgcaggtttgtgttgcggatattgttctgcatggtttatcccctccttttcaggctcatataagccagagattcgtaacctttggcagtggcgcagatgtcatcaatgattgtgactcgtgatttgtcatacgttccgaagttacggatcaggcatccaccgccgccaaccacatacaggcgcatcaggtcaggattatattcatatttgcggagcgtggaaaaaagttctgccacatactgtctggcaatagaactgatacaatccagatatggtgctgaaatgtcagctgttccaaaccgcagaatctgttctactgtggattcttcaattttcactccgaatttgtccagaacagcgttctttgcggcaatcatgcactggtttacaccaagtttttctgtccagcatcggctctcctgagctttcttattgttaatatacagaatgttcatggttccgtttccgatatctgcaaggagattagttcccttgaaattttcaaggtggtttacaatagccggatatccctgtgggtaaaggctacatcccgcaaagtggagatgatattctttgccgttgaaacggtaatggacttctggattctggagcagataggaacgaaaagcttctctttgatttctgatccatgtcagaggaagtccggcagccagatgaacatctgcttcacggatggaaaagacattcagttcccttgcaatagccattagcgtcagaagataatattcttcgtccatagctttatccgggataaattctttgtgtccttcgccaatccggtagtaaatgccgttatattccagaatattcccggtgaagattggttcggtttcataggctttgattccggttggtgtgacggtgtttgctgttttcatattgccatagccatgatctacagcgatgatttttgtgtttttgagttctcgcataaaaaatacctccgttttcgtattgattgattcagcaggtcataccggtgtggtactgctttgctgtgagataagcatacgaaaatcggaggtaaaagacattgagtggaaattgagctggaattgagaaaaaagatatattgtgcgtacattcttcatgtactcttgttgtgatttcattgttttttatcgtataatatggatactggaggtggtttggatgaaatacaagattttagttgtcgatgatgataaagaattggtgaaaatgctttgtagttattttaatatgaaacaatatgaaaccattacggctacagacggaatggaagcattaaataaaataaaaatgaaaccggatattattttattggatatcaacatgccacgtatggatgggattgaagtatgtcgtctgatacgcagtaaagtgttatgtccgattttgtttctaacagcaagagttgatgaagatgataaaattaatgggttgctttcgggtggggatgattatattacgaaaccatttagtcttcgggagttggaagcaaggattgtcacaaacataaagagagaagaaaggcatcaacaaaaaacggaataccgtttcatggatgaaatgctgattgattattctgaaaaaatagtagctatagctggacacaggatggagttcacaaaaattgaatatcagattattgaattcttatccatgcatccggggcaggtgtttgataaagaacgtatatatgcacaagtctgtggatatgatgcggaaggggacagtagaacgataacggaattagtacggcgtataaggaaaaaaatagcggattattcagaaaaagaatacatagaaactgtatgggggattggataccgatggaaaaaataagaaacttgtcactgaaaaaaacaattctgctttattttgtgatcagcttaacggcagcatttctgttatctggatttacagttcattttgcaagaaatatgcagaataaaatatgggaaaaatatattgattatgcagattatacggacgtgtttcagcaatatggaaagaaatacgagattgagatatcaagacctaatcaatcgcagatgaatcgtttggactatcatctttcggaaatgtgtgactttatggaaacatattcggtactgattttttcgattgttgggagtgttgctgcggtattccttttttataaaaataagttaaagacacctctacaggaactaaaagatgcctcacaaatgattgcagataatgaactggattttcatgtgtcctatgaaaataaagatgagatgggaactttgtgtaaagaatttgaaatgatgcgaagtgatttagcagataacaacagaaagatgtggcgaatgattgatgacgagaaggctttgcggaatgcaattgcacatgatatacgttctccactttccatattgcgtgggtatcaggaaatgctcttagagtttgtttctgctgagagtataaaaacagaggatgttattgatatcttacaaacaggcatgtatcagattgaccgtatagagcatttcacggaaaacatgagaaaaatgtcccatttagaacagagggaactgcaatgctcagagatagaattatcggaactggcaaaaaagattgaggcagaagctgccatgctgtccaagaaggaaagtaaattatgtaaggtagaaagagcgcaggaacaaaacattgtgaaagtggatgaggaacttgtcatggaagtgacagacaatttactggaaaatgcggttcgatatgcacaaaaaagtattgctttgcagataaagaaaaaggatggttttcttataatttctgttgaagatgatggaataggatttgtggatactgaggaaaaagtaacagagccattttatcataagaatccacaagatgatttaaagcattttggccttggtatgtatatttctcgtattttctgtgaaaagcatggaggaaatttgaaaatatataatgccagacaaggcggtgctcatgtagaagctcttttcaaagctgaataaaaatactttataaggctgaaatcacaaataaagtggttttagtcttttttgttgtgaatttattgagaattgatttgtatgatgttgttaaagaaataaagaaaggaagagatacaatgaaaacaatcataaaaagaagtatacttgattatttaaagaaccctgttttgtggattggcttgattattatagttgccagtatgtatcaatgtctgtcatcgtatttgcaaattcattatatcaaacagaatgaacagatcacacaaaatgacgtagcattggaagatgctgatgtcatggatgggtacattcccacatctgatgataaagaaagaagaagggagtgggaagatacgatcaaagagacgttaatggacacctccaaaaatggttttggatttagcaggcaggaagcagatcatgtaatgaaagaaattcagaatatggatgtaaagactgcttctgagtttttggaatcccaatatggctattataatgcaatatatgcttatgaggaccttgaaattcataaggggacagcagaagaaatcaatcattatatcgagcggaaattatccgaacattctttttcctggtactttgccaaaaaatttacggattttgcaggattgcatatggccttttttgcaacagtcttgctatcatttttatttattcaggatacacgaaaaagtacctatgaattattacatacaaagcctgttacggcaatccaatatatatgtgggaaagtaataagcggattcattagtatgctgggagtattagtgattttgaatgttatattctttatgctgtgtttgaaaacgtctttagaatcgggctttccagtaacaccaattgatttttgcgtgaattctctgatctatattgttccgaatcttttgatgatatgttgtgtctatacaattacagcattaatatttaaaaatccgcttccggcagcaccaatcttgtttttacacattatatattcaaatatgctgaccatgaagaatgatatttattatatgagaccgttctctattatggtgcgattccctggcagattttttgaaacacatgtagccaaaatgtcaaacataaatcagattattcttgtaatttcatcagttatattagtatgtatttctgttacaatctggaaaaggaggagggttcattgaaaacggaactaaaaaactgcctgtcgttatataagattttttattcatgtgcatttatactgatattgtgtgctattcatccgattatatactatgaagaaatcggttcagcgattcagtcgccaatagcatttttaacaattattttttgtagtgacacatatttgatggaagtaaaaagtaagcgtgccgatgtatttcatttgtatgatcaaaaaaagcagttaaaagtaatatcgcagagagtgggcgttcaaatattatatttattaatactttcctgtgttggatatgttttgtttttctggcaaaaaccgggcagtgtaaacgaaggcatttcgggtattcagatatttcttttatatttcattgcaatgtttggaactatctggctttggagtatatgctctgtgattttgtgtacattgcttcgaaatatgtgggcaggtattggatgtttatttggaattgtcattggacttatatcaaaagcgggaagttcatttttcggaaatctgggattgttttctttcagcttttgtgaacctactcaattaatgtccgagagttggatttatggaacgcttgtgtcttttatagcggggctgtttttatttgcagtattaccaatgactttaaagaaaagaggatagattatgagtattagaataaatgatttaacagttagatttaaaaatggtgtagttgcagtaaataaggcatctcttgaaatacctaagggaatttacggacttttgggtgagaatggtgccggaaaaaccactttgatgagggttcttacaactgttttaaaacaaacggaaggaatggtttcccttgatggaattctgtataacgagggaaattatgagaaaatacagaaaaagattggttatcttccacaggaaatcgacttatatccgaatcttacggtgaaagaatgtcttgtatatatggggggactgtcaggagtagccagaaatgacctcgaacaaagaattacctattatctggaaaagacttctcttacagagcatcagaataaaaaaatgcggcaattatctggtggtatgaagagacgtgtcggactcatacaggcacttcttaataatccggattttttgattattgatgaacctaccaccgggttagatccggaagaaagaatcaggatccgcaatcttttggttgatttttcaaaggatagaactgtgctgttttccactcatgtagtagaagatttagcagcaacctgtacacagcttgccattatgaaaaagggaagttttttatattctggaagcgtgagtgggttgctggaaaatgcaaagggctgtgtttggaattgtacggtacaaaacgcagaagaagcccgtttgttagaagccaattattctatatcatctaagcagtatgtagaaaatggaattcatatgaaagtattaagcaaaggaaagccaaatgagaattgtgtcctggataatgatatcactttggaagatgcatatatttatttgacgaatagttgaatataacggcgggcaagttgcccgccgtaaattatgcttattttgttaaaagaccggatagattttttccaatgcaaaatccaatctgtggatataactcctgaatttcctgatattttgctccaatcatttctggttcatcagcccagatcttttcatatattttgaaagctcttttaaaatgtgttttggcttgcggaagattggcagtcatcagataaatggttccaagggtttcctgtactttggcataatccagacagtcatcggaatggtattccttgatgatgccggataatttttgcaattcagagatgcctctttcgggttcctgctgttctgtcaggaacattgcataattggcaatctgaggtatgctgtcatttatatgaagcaggttaaattggtcaagcagtgagatacttttttccatgtgttctcttgcaagatcgggatgaccgttcatgcggtaaagtccaccgagattggcatgaaggttggaaacaaggcgagcattgtcagcagtgatattttctatctgggcaagtgcatccttttccagttttattgctttttctggcttgatttcaagagtagcctgaaaatccagtaacaatgcccggtcagaatcggtgccaatgtctttacgcttcaaaaaatttttcaattcctgaatgattgctttcatacctttctggtaattataattatccatatatggaaaaacattttccagaaaaagtagatattttggtatatcatctttttcaatcaattctatgatgtttcctgctgtctgaaacagcttcttgtaataatcgacttcaattccatgcattaaacatattttctgtaaagaatccagtaatatgtgacagctacttacagatggttttgtctctgaaagggtgatttcctgaatcatcggatgcagagagatggtgcgacgtgttgttgtctgaacgaaaccagtctcaattaaatcgttgatttcatttagtgtgggcatttccagccatttggcaaatatacgggcagaaataccggtggaaggaagaaagcacatattacacatgatatcctgctgttcaagagataaagtgtataaagaaaacagcgtatggatatgactgtaataggtggctttgctgctttgtccatctttgattattttaattttatcttcgttatggaaagatgctttttccacctgaagtcttgttaataactggtctggagttgagattccattttccagaagttttgctgccagttccacggcaaaagtatgagagtgaacagtttcgatgatcttttcaactgttgcccggtacgtgtctgcctctgaataaaatactgatgccagctggaagagagcgttcatatcctctatttcttttaatggcagagtacagtattcatccagtttgcttcgggttgtaaacaaaatctggcagcgatattttaatactactgacagaaagctgtcctgtgtcgcagtgacattaaaattatctatgataagcagagtatcagatttcagggaacgcagaaaacggttatgtctttgaaaccgttcctggtcagtgctttccggcggatcgtcaataaaatccatgtcagtaatatcctgatgaagattgccggtatattctatataaagtatattggtgtattgctttatgtaccgctttgcgtaggctttggcaagttcactttttccgattccggcgattccgcaaaggaaaacatgacggttttcctcaagcacggtatataattcttccagttctttatctcttccgataaaatgacggcatggtttcggaacctcactgtccataatataatccagcacaatgggggataaagcgcctccggcgagcagcttctgatttttggtattacgtttgatgaattggcgttccatgccaaaagaaatcagttttgcaagaaacagcagtcttgaactggctggtttatataagggagtcagatttttcttttttgcatctgagatgctgtcatcctgaatgaataaagtgtaaatatcttgtatagccatattacagtcagacatcagtggaagaagattctggtggatggtatgggctaatttttcctgattggatggcttggaatagtaagcggatattttaggactgattttagcctgaccagtcatccagcggcaaaccagaccgttgtccattgaaaaatcctgatttaccggatcatccataaaatcttcaaataattcgtataaaaaatcaggctgactcatttgattactttcgctgatatgattttttaagcaagtgctaatagaagaaaaatcgcatcgattcaatagaaattcccctttcgtagttaagattaagtatatctatcataacacgaacatatattcgattcaagaaaatgcggatatttttaaattgattgtgtcaatttacaatcaatttctattcaatgtggttttccggcaggttctgtaaaataagctcagatcaaaacaataacgggaggagcttatgcaacagaatattgaatttgagcggtgcattgattttctggtacggatgattgataagtacggcgctgaagtcctccgggagttggaggaaaaaaaacagaataaggaagaaaaagaagcggcagtttcctgaaatacaaaatgtaaatcagactgtcgcttttttcatgcatttttaaatcaaataaattttaaaagctgatgcagagtgtgtggctcattattctgagaagcggtaatacgcgtatcaaatggcttgaaatgattctgcgtataaaagctcagaagaaattcattatcttcgcattcaagaaactccataacgccacctacggaatatttgagactggatatggtttccagtgcaaatcccagtagaatatttccaggaattcgtttttcctttggaagagaatagttctttcccaactgggcgatcaggtaagctgcggtagtataggattgtgtttcttcatccaaaatactgacacgggacagtttttttgccattgtcttgctgatatttgaagcacggacagagattggttttattgtaagtgaaaaataaccaaccagtgaagcatcttcagcatcaaataccagataagtgatagattgatcttttttggtaaactcaatcgcattatgtaataaaaagtattccacatcgggatttttgggacaagaaaaatcggagagtaagtcgtaaagactttcctctccgatatatgtcggttcgtctttatccaaatatgcccgaatattaacggtaaaatatttatcagacatgttttttcttcctttttgacattaaagctaagatttcctgtgggttcgttaactgacgtccgggaagtgtctgctttggtgtgcggtcacggtcggcttcgtcaattgctgcgacaaaacgctttacgctatttggattggatacgacaaaattatgagtaatacttgaagtagccatactaacacctcctcttttttggcttttttgtgtatttatagtatatgcaatgtgtgataaaaacacaatatcaaaaacagaaattatttctaaataattttcaagccggacatttattagacgcttccggtaagcgaacaatattttcgagccaatcatttataagtcgccaatggtgggcgggcaatattttgataacagaaatgctctgtatctaacttaattatacgattggcgaagaaatgcgtcaatacggaaaataagtattgaaaatagttggaacaagtactaaaataaggttgggacaataaaacagagttatactgcgaggaagattatgaagaataaaaagattaaatgcgatatatataccagagtatccacaaccatgcaggtagatggctacagtctggatgctcagaaagaaaaactcaagagatatgcggaatttcagaatatggaaattgtaaatgagtattccgatgaaggtaagtctggaaagagcgtagagggcagaccggaatttcagagaatgttggataatattgagaatggaacagatgaggtacagtttgtattggtgttcaagctttccagattcggtcgtaatgcggcagatgtattaaattctttgcagaggatgcaggattttggagtgaatctgatttgtgtagaagatggaattgacagctcaaaagatagtggaaagctgatgatttctgttctgtctgcggtggcagagattgaacgagagaatatccttgttcagacaatggaaggacgtaagcagaaagccagggaaggaaaatggaacggaggattcgctccatatggttatgaattggtaaatggagaattacagattgcagaggacgaagcggagattatccgtctgatttatgacaaatttattcatacaaatatgggaatctctgcgattgctgcatggctgaaccagcatggatataaaaagaaaaaacgacagaataatacactggacgcatttgcctcttcctttataaaaggcgttctggataatccggtatactgtggaaagctggcttatggacgaagaaaaaacgagaaagtttctggtacaagaaatgaatatcgcattgtaaaacaggaaaattatatgctgcatgatggtatccacgaagggattatttcagaaacagattgggagctggcacatcaaaaacgggaaaaaacaggtgtgaaatatgaaaaaacgcatagtctggatcatgagcatatcttatctggaatattgagatgtccgttatgtggaagcggtatgtatgggaacgtgaaccgaaagaaaaagaaagacggaaccttatataaagattatttctattatgcctgtaaacatcgtcgtctggtagacggtcataaatgtggatatcgtaaacaatggagcgaggagaagattaacaatgcagtggaagaagttatccggaagctggtgaagaatcctaaatttgaagaagcaattctgaataaaatcggttcaagaattgatacagaagaaatagaaaaagagattgaaggattggaaaagcagcacaagcagttgaccggagcaaaagcaagacttggacagcagatggacagtctggatatcatggataaattttatgagaagaaatatcaggatatggagacaaggttataccgtctgtatgatgaaattgaaggcgtggagaacagtatagaagaagtcaagaatcgcctgttgaatattcagcaacagaaaatatcagaagaaaacgtctatcaatttcttttatattttgataaactatatgataagttcaccgacctggagaagaaagaatttcttaacagctttgtggaacaggtggacatttacgagcaggagcagccagatggcagatttctgaagcacataaagttccgttttccggtgtattttggagacagggagacacaggaactttgttgggacaacgaaagtaccgttgagacggtctgtttgatgtctaagaaagataaataagtaccaaaaagtggcgtatttccgggccttttgcgaggttaacaccatcacgggagccttgcgaaaagtccggttttcttgtatgagaacttatctaccggacagtctgcatgaccggaattgaaacggtgaaaaatgcggtagggtttagactgcggattagatgtcagaggttgaggcactaggattgttgtcagagccgaccgcagttcagctcactcgatactcgaaggagtagcaggcagtggaatagataacggagataggaggcggtaatgtgagtgattctcagattacaattttttattcttggcaatctgatttgccgggaagtgagactagaaacataattcaggatagtataaaagatgcagttcgtttactgagagatacagtcgatattgaagctgaccgtgatacaaaaggagaatttggttcacctgatattgcgcagactattttctcaaaaatcgacgattgcgatatttttgttgctgacgttagtgctgtatgtcgatatgaggcaactgataaagatggaaacaagaaagtaaaatatatgccgaatcctaatgtaatgcttgaattaggatatgctactcatgttgtaggatgggacaatgtaatatgtgttttaaatgctgattatggcgcaccagaggatatgccttttgacattgcaagtcgaagattgaccccattttcattaaaagatgggaaaagtaagggagagataaaacgatatataaaaggggtaatacaagatattgtcgaaaacatattagaaaatggaaagcgtgttaaaacaggtttttcagatttacgtctgggttgttatgatgacggctctatttctaatatgcttcacccgattgaggtatcaaattcagtctcttttgttaagcacaaaacacaaatattagacgaatctttgaagctggtagaacaaatcagaagtatgaaaattacagaaccatctgaactcctaaatacagaagaggcaagtaatgcagatgagaaacagacaagcaatgcaactgctattattagaaaagatggctcagttctaactcctgtcactagctctttgaaattaaatcttttcaaattacagagggtacatatcaaggatgaggatagaaatacgataatagatttgtgcaaaaattatcttggaatagatatatatgaagatacagattttttcaatattggaaacttagaaagaaaatatgatttaatgtcatcatattcttatgaggggacgaaagacgaggagaacaaatatgatagtatcatgatgcttgaatataatttacatcgtgtgcgaatgctggattggtatgcgacgacttttgacggattgttttttataccacttgcaattgaaaatgcatctaaagtgtacgatgaggatgtagatgtacacgttaagataaataaaggtgttgtagaagtgattattccatcgaaggagctcataaatccagatatgcgaggcttagagggtttgatttatgaagaagatgttataaaggaacttttgatgatgcctgaatcatcagatatttcttatgataccgatatatcatacactttagcagatagtttggctgaaagtcaggcatcagtgagagctcagttcagtggtgctggaattaacggaaatcctcgatataattcagatgattatggcagggagataacaaagtatattgcaatgcctaaagctaaaagcaacgatattgagtttgaattttctattggatctttaagagcaaaagaaaagaaatggttaggaccagccttgttagtaaatccgttaacagacagtttccatatcgaatactctataaaatctaagcattcagatggagatttgtctggaattgtaacatacactaaataaagagaggctccccatcaccggagattatccagtggtgaggagccttcgtgcgtctatggagtcatgcatcaacgtcgatgctgacaccggattttagttctacggtgatgtggttcatttagttctccatcagaaattcatttttatatgctattctttaaaaaaggaggttggcttatgcaaaatattttagtcgtcgaagatgatattgatattcaagaaatattgaataattacttgactgacgctggatataaagtaattattgcttctgatggtgttgctggaattgctaaattcaattcagaaattgacctcgtattattggatattatgctccctaagattgatggttatggtgtgtgtgaggttattcggcaaaagtcaaaagttcccattattatgctgacagctctttcggatgaagaaaaccagttgcgaggatttgaacaacaaattgatgactatattccaaagcccttttcgcccaaaattctgctctgtaaaattgctgctattctacgtcgcggtttacaagataacattgataaggacattatcatttataaggatttacgcatggatattgagggtttccatttgtattgtaaagagcaagaagttatattaacgcagaaagaatttgatttacttcgccttttacttgaaaatcaaggtcgagtatttacacgacaaatgctacttgatcggctatgggattttgatacctatgttgaagaccgtattgttgacagccatatcaaaaatctaaggaaaaaattaaacgtagattatatagaaacgattagaggggtgggatatagaattgataaaagcaattaagaaaaaactgtcgggaaaagtctttctcattacgtttgtgctacttgtatctgcttgcagcgggacttttttctgtatcttaaaaattatgccatcctcatacttagataccttaaaccgaaatgcagaggcacaatctttagagttgctggataccctgtctacttatgataatctggacaagtgcataaaagctatatccgactttgaaattcaaacagggtcaacggtctggcttgatgacgaatatggcaatactctttatccctcgaatgttacgactgaacaagacatggttacagccgatagttatgttacatttgacggtagcaatacaacagatgagaatgtagtatcgacggaaaaagatacaaaagcttaccagttttcattgaaaaacggggcatcctacacgctcgttgtgataacagacctttatgttgtgcggcaatcaacggaagtgttgttgtctacatttccctatgttatcgtcatggtgtttattctgtcaatattgtgtgccttgttctattctcgttttattactcggcctgttctaaaattgagtgccacctcaaagcaaatggcaagtcttgacttttcggggcggtgcgatgaaacgcgatctgacgagttgggatgtctggctcataatttgaattgcttgtccgactcactttcacactccatgttggaactgcaagaagcaaatgcacagcttaaaacagatattgaaaaagaacgagaattagaacgtcagcgaatggacttctttggtgctgcgtcccatgaattaaaaacgccgcttactgttctaaaggggcatttatcgggaatgttgaatggtgtggttggctatgaaaatcactccaaatatctccaacgctctttagctgttacggaaaaaatggaagttcttataagagaacttctctatatttctagaattgaaaaaaataaaacttctatacaatttgcaaatattgattttgcagaattactccgtacagtgattgcagaactaacagattttatttcagagaaaaaactatccctacacataaatataccagatagagtgagttgccctttggatagggcggaaatggaacgagctattcaaaatattctaataaatgctatacgctattcaccagatggcgagcaagtcattgttactgtcactgaaactaatactataataagctgtagtatcgaaaatactggtgttaaaattccagaaactacgatttgccacttgtttgaaccgttttatcgcgtagacatttcaaggaatagcgcaaccggtggcaccggcttaggtctgtatattgtccgaggaatacttgaaaatcataatgcagaatatggtatcaagaacaccgaaaatggtgtgtgtttctggctgagacttccgaaaaagcaataaggtaactccatcaaaaatccacattccctgcaaattaaatccaaatcgctttgatatgatatagtcgtccccaaaaggggcgactatattttttgaaagtgaggtattgcttatgagaacaaaaaaattacttggtatcgggctgggaagtttgttactgcttagccttgtcggtttcggcacagccgcagcagctcaacatcaaaccgaagccgagcctcccatttccttggagaaagaagtcttgtgccgaaccggggaaaatggcttacagttcagccttgatggtaatagctggatgccgcaatctgaatatgaaaaagaaattcccaaaatcgactggtggactgcttctgaatatgaagattggatagccacgcaaaaaaccgaacttgaggctcttattggcacaggagatggttggtatgatgggcagggcgttttccatgaatggacacaagacagcgtaaatgcccaaatcgcagagtacgagaaaatcttggacgagatcaaatctggcacattgtattccaaagataacgacgagggtatcggctatgcacagatccccccggatggcaaagatattgtctctgtctatggggcgaattttgttcggagcgacgggagttctttccacattggtgattttgccactcaggaggaattggacgatgcgattgaaaaggctgtatcagatggtcagataacacaagaagaggctgatactgcatcttaccagtaaatatgtaaaatctgccggacgacggcaaagaaaaagccgtcgtatagcagacaaattgccatgcatctatttcttgcggcggctttgattttcagagccgccgtttcttttcgtctatcccatctaaggcatttaccgagttttgtgagtccatgaatatcacacaaagtatgagcaaagcgggatacccttatgataatgctccgatggaacgttattttaatacattgaaaaatgagtgcaccaacctgtatgaatttgagacagaggaagccctctatcaaacggtagatgatttttcatatgttgaatacaattatgtgcgcccgcatagttataatggttacgctactccacatgaagcaagggtggcgtagctggagcaagatattttttagccacaagtgttacaaaaatgcttgaccacagcagttcgggcgttttattgttggcataagtaaatgatgggaaaagtgaattgtaacttaatgctgatattgatacaataaatttgataattatgctaagcgtaggtattgaaatagaatgaagaataatatgagaatagtggatatagatatggactatttcttaaaggaaatccctattataatatcggaaaacaatacagatagattaccagatgaagattatcaagtatggagcaaagatgaagtgattgattttttggaaaataaactggggctttctaaagaaacaaaaattaaggggaaaatagtcacccaccataatgaggcattatattattggagaaagttaatacaagaagagagattgtcgataccttttgaagtagtacatattgattcacatgctgatttgggtttgggatatccttcttggacatttattattgactctttgattacagtgccagtagaagaaagaacaaaaatagaaaattatggtaacatgtttgaaaagtattatgagccaagaataggagattatttgttatttgcactggcgttcagatggattaaaaaacttgtttatgtgtgtaatcctgcagacataggaaatgattatgtgtggatgattttgaaagatgggatggaaccaaatgataaaattcagttggttcataatgaagagatgaaagcgatagagattgcgtcaaatacagaaaggtattatgcaacagcaaagcgtgaaccagaggtggattttgaaattgtaaggtgtgctgagaatatcagttacaatggagagtttgattatttaaccttctgtgtttctccgaattatacaccaacagctgctgattttattattgaattaatgaaagaatacattgagggggaatagggtatggattatgatagatatattgaattatacagacagggaaaatttcaagaggctgttgagtataaggcaactcaagttccaacaagattagtaaagtattatagcttgaatgataacgtaactgttaataaatcaaaattacaatatctaaaagagcaaagaatatttttaagtacagcttccggatttaatgatccatttgagggaaaattttttaagtttgataaagataaactggaaaagagtggttgggataaagagatggtagtagattactatacttctgtggcgaatggattccgatacacttgcttgagtaatactgatgaaaataatatgccaatgtgggcttattatgcaaacaatcatcagggtttttgtgttgaatatctgctatgtgatatgcagaagaaatatatttttcctgtaacttatgagccagaaagagtatctgcaaatgctattactacaaatttattatatgaatatatgaaaatgaaagaggaaggcagagagtatacagatacatcagcggatgcaaatgtctatttgcagatgttgattttatctcttgcagcaaaacataaaagttgggagcatgaaagagagtatagaattatttgtcatcgagatgattttccggcaattccttccaaaatttacataggtcttaattgtaaagaagaatatagaaaagagcttgttgaagtggctaagagtattgatgtatgcaaagcatatcaaatggaatttgatgaggatagtaaagtgtttggtttgaaaaagagattattaatataatacgctgaaaaggggctatgatattatgtcaaatgaattaaaaattataaatgatgagaattatcagaaatggatttgtgagataaaggaactggttcatgtcagccaattaaaagcggcagttcaagtaaacacagaaatgataagaatgtattggcatattggaaaagaaatttcggataagcatgcagatgcaatttggggaacgggtttctataagacaatgagccagtctttaaaagaggaatttccaagtgtaagtggtttttcggtgacaaacttgaagtacatgaaacgcttttttgaattttacaaaagtgataatgaaaatcgtcaacaggttgttgacgatttggaaaaaatatgttcaataccttggggacaccatattctaataatgacaaaatgcgaaaatgtaacagaagcattattttatgtacacaaaacattagaaaatggttggagcagagcaatgctgcttaattttctggatgtgaatctttataagtcacagggaaaagcaataacaaattttgacagacagcttccggctttgcaaagtgatttggcgaaagaagtaatcaaagacccatataactttgattttctgacattaacagagggataccgagaaaaagaacttgaggatgcattgacaaataatataacaaaatttttgttggaattaggacaagggtttgcgtatatcggtagacagcaaccgattatgattggtcaaaaagaaatggcaatggatcttctgttttaccatatgaaattgaggtgttatgttgtcattgatttaaaagtaggcgagtttgatgcatcttataccagccagatcggaacttatgttgttgcagtaaatcatcaattaaaaacagagatggataatccaacaataggattgattatctgtaaaacaaaggacaatgtggttgctgaatattcactggaagctagtagtgtaccgatagggatttctgaatatcagttgtcaaaagttcttccgaaggaaattgaaagctcacttccttcgatagaggagattgagaagtcgttgaaagctattacaggagagtaaagccggataaacagagatgtatcagtatggaaatattagagaaatcaatgttcctaattaaaacatttagaagtaaaagaaaacgaaaaaagaagtcatgaacatagatttcctagaaataaaatggttggaaggaatgatatgatgagagatgattttaaacaatcaacaataaacttattggcaaatcgagttggatggaaatgtagtaatccgggatgcagaagaacgacacgaggtgcaggaacagaatcgacagatgtgattaatattggggtagcagctcatattacagcggcagctaagggcggtcccagatatgacaataatatgacttcccaagaaagaagatcatacgagaatggaatatggttgtgccagtcatgttcaaaattgattgattcagatgtacaacgatactcggtagataaacttaaaaaatggaaagaaatatcagaacaaatggctgtacttgaattagagacagggacagaaggtggatatacaacagacagagaaattattaagtttcttgtatgttgttttgaccgcccggcatttagagatccaatttgtcaggaaggaagaatggaagattttgataaagcaattgaggatacaataattgccttaaatacaggtattcttagaactagagacggaaatattttaagaaaatcagaggggaaatcagccattagtaatgatgagtggcgtgaaaaacttaatgtaattggagatatgttatctgcattacgaagacgattaaaaatagctaaggcagcaggggcttattctacctatggtgaaggagaggtaatgtattgctttagtgacaggcaactaggagagtggtttgattctactcgtgaagaaatactgaaaattttatcctcgatttgtgaggacatggggatgtcaggattgcgttttccacgaaataagtatagatggtaaattatacggctagattacatcatgaaaataagggataatggataggcttaggatacgagagaggaaataatatgaactttttgattaatagattggataatttggatattggtagcaaaagttttgagtttattcctgaaaatattaagaaggatataaatatggatggaatgattgttggtgcaaatggtcagtttttggttaaccaaaaggatataatggttttgataaaaaaatcaggtttgaaaaatcaaataggtgaaaatatgtataatgctatattaaggaagccaatgatggtttttttaatccctacacaagaaaaagaatttgaaagtaccaaagaagaactcgatatgacatatggtatgaagttaatacatttaaataattttgcgcaggcattttctttgggatgttggtttgtaaaggattcttgcgttatggctaattttatttattggattaatatgcttaatggatataattcacaagatacaagagatatgcccataactatgagtaatgggacgatatcagaaatatgcctaacagatgttgaaatggcagaagcaattgatagaatgtatgaagtatatcgttgtttattgccagatgagtccgcaatggggcgagttgaaaatacatatagcgtaggaacacaggtatggaatatcgataaagcaataagtacggagggaaaaagttttgcaagagctttgataatattacaagaagctcgtagaacaggagtcttatcgagtaaaatagataagtattgttctgttttggaatgtatatatgccataaagaaagaacataagaagaatatatccaatattactgctgcatacatagggaaagatagtgaggaacaagaaagaattagggaaaatatgagagatgcctatggggtacgttcggatggctctcatggagataatttgaaatatttgcaagaaaacaatagggaaaatttggtgaaattatcgacagatatcgatgattatgttagaagagtttttaggaaggttatcgctgtagaaaatttaaattataataatacttcggaagaaaaagcacgtgtaagaaagtattttagcgatttggcgaaaacggtttatcctgaataatttagttcatacatggtgtaagactgtatgcaaaatgttataaagtagataaatgattttgttactttatcaaaatgagtagaatcaagcctccaagtccacaaagatttggaggttttcttctgcccatttttagaggaaagtaatttccgaaataaacaatctatggtacaatatcctagaagttatccacggataagtgaaccatagagaaagagcagaacacaaatcacacgcaggtcagtcagacctgtatctcaaaacaaatctaatctttttctatggcagatgcaaagtggtgcatcatgcttatttttgcaggtccgatagaggaccgttgcatcatttttgaatccaaggcttaacgaaaagccaggggatgtgcatctttattgcacactcatggcatgtggagacggttgccttactttccaagggcgctgagcaaaggtccggtggacctttgctcagcgcggaccgaagtggaacggagaatggtcgacagcaggaaagtgaaggtggacttctctctggaggatatggatctagctgaatttaagggaaaagcaacttatgagcagataaaggcatatgtattggaacagactggacttaaggtttcttcgctgtatattgcacagattaagaagaaatgcggactggatgtcagtgagaacttcaatctggctaaatcagagaatgccagacagccacagtgcacaccggagaaggaagatgcgattatgcaggcatttagacattttggaatcatatagattgtgaataagtagcatcgtgtgttaaaaatatagtaaagtatgggaaaaggacattccggaactgtagattttacaggtcaggggatgtcttttttgctgatatggaagtgttcaagggacaaggtaatgatactgaagtaataagactaatatgaatgatatctatcttatctgattagaagatatggattgatggaactttggttgcttttagtatatattaacagcccggtatttgactttggtactggactgtttgctaattgaatccactacaagatattgaatggaagtaaatgatatgagacaaggtttgttcatgattcttcgtaatgcctagattgagatttttgccaacttatgatattcttatatttgggttttgcacccaaaacacatagaaggtcagggagcggaactatggctaaaaaagaagcaaattttgatttatatatacacgatctgttagttgaagctggcattcaggcagatacacagggcagtaacattgtacctatcaatgaagcactgaaaacagcgtcaaaacaccaaacaggtaaggtaggatttccagaatacatagcggttgtagatgattttgtccttgtcatggaagataaagcggaccgtgcgaatctttgtttaaaagaagcagatggcactatttctatgacggtacaggcaacaaccgattatgctgttaatggtgcgttgcattatgcacagcacattttgcagaaaacaacctacaaaaaggtctttgcgtttggcaatgctggtgatagcaaacatcacactttacagccactttttgtagataagaacggatataaatggctaccggaagtccaaacttttgaaaacttttcaatggcacatattgtggaatattacaaacgacttgtgcttgaagaaacacctccggaagatattgaacttgcagatattttaaaaaaggcaaaggaactgcatgaatatctgcgaaattatggtggacttggggaagatgaaaagccacttgtggtatcagcaattcttcttgccttgcgtgaaaaagaatacggttttaatttaaatcagttgacgggagatacactggagagcaacacggacggtgctattctgtatcaatatcttgaaaaaaatttacaacgtgcaaaagttgccccagaagtaaaaaaacagcgtgttttgaatcagtttacgttgataaaggatagaccacagttaaacacaaagcgtgcggatttaggagataaaacacctctgaaatattttgcagagtatattaacaacaacatttttcaggcgattgtatcaaatgggcgtgaagattatttgggacgtttttatggtgaatttgtttcttactcgggaggtgatggtcaggcacttggtgttgttcttacacctcgtcatatcacggaattgttctgtgaattggtagatttaaaaccgactgatgttatatttgatccgtgttgcggcacgggtggatttttgatttctggaatgcataaaatgctacggttagcaaaaagtgatgcagaacgcaagcacatcaagcaacaacaaatttatggaatagaaattcgtgacgatatgttttcgattgcaacaacgaatatgattttgcgtggggacggtcaaagtaacttgatttgtgaagattttctggcacaagaccctggtgaattgcagttaaaggggggtggcattacagtaggctttatgaatccaccgtattcacaggcaaaaggcaaggacacagcaaacctttcggaattgtgttttatccgtcatttgcttaattcaattacaacaggcgggcgtgtagctgtgattgtacctgtgtccgctatgattggaaaaacaaaagaagataaagccgtcaagcaggatattctgaaaaaacatactttagagggtgttatcagcttaaataaagatacattctatcgggtcggtactgttccatgtatcgctgtttttacagcaggtgaaccgcatccggcagataagattgcaaaattcatcaattttgaagatgatgggtttgaagtcaaaaagcacttgggattagtggaaactgaacgtgcaaaagataaacagcagtatcttcttgattgttggcgtggcaaggtggcggattttccatcaagtttcatggtggaaacaactgttgaagatacggacgaatggttacattccttctactactataacgatgaaataccaacagaagacgattttatgaacagtattgctgactatttgacatttgagtttaacatggtcacacatggtaaagggtatctgtttgaacagaaaggcggtgataataatgcttgagttgcatgatagagaatggaatgaattctacttacgtgatattttcccagatattcagcgtggcaagagattaaaaaatgctgaccatatacagggaaagactccttatgtatcatcttctgcaataaataatggtgttgacgcatttatagggaatgatgacaaagtaagaaagtataaggaatgcctaactttggcaaatagtggcagtgttggaaagactttttatcacagctatgaatttattgcaagtgaccatgtaacatcattgaaatcagatagattaaataaatacagctatttgtttatagcaaccattgtccagcgccttgaggaaaaatatagtttcaaccgtgaaataaatgatgtgcgaataaacaaagaaaaaattgttttacctgttgatgaatctggcacacctgattatgactttatggagcagtatattaaagaacgagaacagcaaattgtacaaaaatacattgaatatactggtaaaaatatccaattcggggggggggacttccgccgttgaaggaaaaggaatggaaagaattttacctacgtgatatttttgttattcgccctggaaagcgattaacaagaagtaatatgcaatctggcacaaaaccctttataggtgcgtccgattctaataatggcgtaacggcttttgtaggcaatacgaatgcgtcagaggatcgaaatgttctaggagtaaattataatggcagtgtggtcgaaaatttttatcacccatatacctgtattttttcagatgatgtaaaacgctttgttttgcgaaaacacaatggaaacaaatatatttacctatttatgaaaactgtaattcttcaacaaaaaaacaagtatgcttacggctataaattcaatgaagaacgtatgcagaaacagatgatactattgccaactgcagctaacggtcagccagattacgattatatggagcaatatgcaaagaagttgtttagttccctaagattacaatatctgcacgaaaaagtgacggttgctatttgaccgtcactttttcgaggtacaatatatcattaagtcctattgtatccatcaaagataccgaggttagtgtgaaagtttgcttgaaacagattttttctttataattgattgttttgtttgttgttgggtatgagagcggcatgacaatggtagaaattgcgaagcggaacaatgtcagtgagaggacgatttataggtataaagcgtattatgacaaaatgaagaaaaaagaagaatagaccattttgctgatgtcagcaatatgttatatgagagttgcggacgatttttttgaccgcaaaatggatggaggagttctatggcagaagataaaaagaaagaagaaattgctgtgattgatattacagaagaatatttgaaagaaagaatttatgaaattcgaggacaaagagtaatcttagatgccgatctttctgaaatatatggttatactacaaaagcatttaatcaacaagtaaaaaataatattgagaaatttgatgaagattttatgtttgaacttacggatgacgaggtagaaaatttgcggtcaaattttttgaccgcaaatcttaacagtaagagcagatataatcctcatgtatttacagagcaaggattatatctgctgatgactgtcttgaaaggaccgttggctgttaagcagagcaagcggacggtaccacaaaatacggttccgtacagctggtaggagaaaccggatatctggtggtcagcaacatgccgttccttgaatactatcagatgctgtttgcgacgatcggcgtactcttagtcattttcgcagtgggaattatcgtggtgatgcgcagcatcgacaagagcgcatatgcgctgtcaaaaccgatcgcagaattggacgagacggcaagcaggctggcagagggagatctggatgtcgagctgaatgttacggcaaagaatgagatcggagaactggcggaatcgattcgggcgacggtcgcgcgcctgaaggaatacattgcctacttaaaagaagcatccggcgcactggatcagattgcagacggaaagctggagattcatctcgaacaggaatatgtcggggaattccgtcagttaaaagacgcgcttcttcatatttcaagttcgatgaatgatgtcatgaaaaatatcagcgcaagttcccagacggtgacttcgagtgccggcgatctggcaaatgcggcacagcagctcgcagagggcagcggcacgcaggcggcagcagtggaggaactggtcgcaacggcgacttccgtggtggagcaggtggaggagagcaaaaaagacgccctgcattctgccgaggagacggagaaagtgacagccatgatggaacagagtcaggataaaatgcaggaaatgatggaggcagtgcagaaaatccacgagacgtcggaacaggttgtcggaatcattgcgacgatcgagcagatcgcggatcagaccaatctgctctcgctgaatgcatctatagaggcggcgcgtgcgggcgaggccggaaaaggatttgcggttgtggcggatgagatcggaaaactggcacaggagagctcaaaagctgccaatatgacgcggaatctgatcagcgtttcgatggaggagattgataagggcaatcagattgcggatcatgtgatggattccctgaagacggcggtagaagccgtggataaagtcaacacgatgatccagaagacggcggaaaacgcggcggatcaggcacagagcatggaacagatccgggtaggaatcgaggagatctcgcagggagtacaggacaattcggcgattgccgaggagagctccgcaacctcggaagaacttgcatcccaggcgacactgctcaatgagctggtgcagcattttgaactgcagccataaaaacatcgaatcccttttgctgacattattttcttaaagtggtaaaataacacaaaagcagcaaaggaagtgtgacagatgaagatcaggcttgtacagacaataagaaattatgacaagaaaaatctcgggaaggatctgaccgccgggctcatcatcatggcggtctcgattccgatctccatgggatacgcgcagattgcgggactgccggcggtatacggactgtacggatcggtgttcccgattctcctgtttgtgttgttttcgacgtcaccgcagttcattttcggcgtggacgccgcgcctgccgcgctgatcggagcggcgcttttggatctgcacatcgagagcggctcagaggaggcgctggcggcagtgccggtgctgaccgcgtttgtggcgctgtggcttctcgcgttttacgtgatgcgggcgggaaagctggtcaactatatctcggcgccggtgatgggaggctttatcaccggtatctgtacgaccatcatcctgatgcaggtgccgaagcttctgggcggcactgcggggacgggagaattctttgagcttgcggagcatatcgcggagacggcgggggagatcaacctgccgtccctggcgcttggcgcggctgcgcttgtgatactgctgattgcaaaaaagctcatgccgaaattcccgatggcggtccttttgatggcagcgggcgctctgatgacaaagtacctgcctctgcgcgcttggggcattaagacgctggatgctgtggagccgggacttccggtctggagcctgccggattttacggcggtgccggtaagggaggcggttacgatcagcctgtcggtggcggttgtcatcatggcggagacgctgctcgcagaaaataattttgcacagaaaaacgggtaccgcatcaacgacaatcaggagatcctggcatttgcgatgggcaatcttgccgcggcgctgaccggatgctgcccgatcaacggctcggtctcccggacggcgatgggagagcagtatcaggcaaagacacagctgaccgggattgtggcgggactttcgatgatcgtgctgctgcttggcggaaccgggtttatcggctatcttccggtgccggtgctgacggcaatcgtgatctccgctctgcttggcgcgacggagtttgagctggcggtccggttgtggaaagtcagccgcacggaatgtctgatctttgccggtgcattcttcggagtgctgatgctcgggacgatcaacggcgtactgatcggcatcatcctctccttttccgagatgattatccgcactgcaaagccggcgcgctgttttctgggaattcagccggggcaccggcatttccgcgatctgaaagaaggaagccagatccatgcggttgagggagtgttaatctaccggttcagcagcaacctgttttttgccaacatacaggtgctaaagcaggacatcgaggaccatgtgacggagcagacaagggcggtcatcctggatgcgagcggcattggcagtatggacatcacggcggcggacggactgggaatgttatatcagtcgctgaaagaaaaaggcatccgcttttacatgacagagcacatcgccgatttaaacgaacagctccggaaactggggcttggctacatgatcgaagaaggaagcgtgcgcagaacgatccatattgcgttaaaagatatgggaatcaagcgcccgtatccgctggagggcggtgtggacaatgacgaccgcagtgcctcgagaaagcgcgcggacaaccgcgtgcaggaatttgtctgggcatttggcacggagacggaggaacagattgaaaaacagattcttttgcagattgaacagctgaaggagggcggtgatgtggaaaatctgctgcatggcagatggtcacacatggaagcaatggatgaagacgagtggctggaacatctggaagaacacttaaaggagattgtgaacatctccggaaaggatgagaagacactcgcaagacgtctggaggaacaccgcagggaggtgcatgaccgcattgcaacagagcatccggagcttgcggagcgcttcaaggagcgcagacatgtactggatgagcatttaaagcagagaagaccggaggtctatgagcttgtggtgagtctgcgcgaaaaggaaaagacagatttaaaataaagaaacaacaccgttatttaacagggtgccggagagcgcaatcagcctctcaagcggcactctttttttgtctgccacccactgccggtaaatattgacggaggtgacgcataaaaacgtgttgatgatattctgctcctccctggaaaatgcggcgtagggattatgtctcgtgcgattgtgaatcatggtgtttaagaataatttatcggcgaattcgcggtagcccggtgcgcataaaaggcgctcggcgtacggctcctgtctggcggtaaactcgaaaaagacgcggtttacttccgtaaaaggcgcatcgatcgggagctggtcgatggcatggtaatactcttcggtgatctgcccaaggagatcttcaaacagagcctcgatgcaggtatagtgcagatagaacgttttccggtggatcagaaatacaacgagtgccatgctcagaaaatggatgaagaatactggcaagtgccgcggcagttgtgctatactgggagacagaacgacacaacagaagaaagggagtatgatattatgatgaatccggcttcacttatgaagattatgaatgcgagaaacaagttcgttgagaaccatccgaagtttgcggcgtttttaaacgcggtattttctgcgggcattacggagggaacagtaattgaaatcaccgtcaccaagccgggcgaggagccgatcacgaccaatatgaaggtgctccagtccgatctggatttattggacgagttaaagaatctggcgcagtaacccggcgcgcgcgcactgcatatgatatagcgaagttatctatagggagtatagagtggactataatcaggagcagtttttccgcgcgcagtttgatgtgcccaagatgcctttttatatgagctaccccatgcagaatctgtatctgaccgagatggagtatgagaaggatatggaccgcatgaaggagctgtatcccaaagaggttggcaggattgtggagtgcgtggaagacgaatgtgacagaatggaatacgagggcagcctgatgtttgatgagtatccggaccgtctgatgattgagatggtggtagaccgcatccagaagaaagtcacaggagaagacggcgaactggaggcagagcagtttcacggaggcatgcagccgccgcccggacacagaccgccgccaccgccgccgcccggacagaatgatcatctgcgggagctgatcggtgtgattttaaacaacgaaatgtaccggagacgctgccgtcaccgccgctgcagacgctggtggtaacgggggtgcgaagccccggataagatcgaaaacaattcttaaaaatcagagaaagtcattgcggatttattttaaaatgcatacaatataactatcgcgtttttgtgcgatagttattttgtgttaatataactatcgcgtttttgtgcgcggtagttattttgcgttatataggaggaatgaccgttgcggaagggaaccataaaggcagcagtcttggcggcagtgttcatcggagcagtgcttatatttggaagatttatgaatgatactaacgaggatctgacgacggagatgaaggaggcgacgctgccggtcatcaccatgtatcagggcgatcaggagctgaatgaactacacgggtatgtgacggagatggatgccgcatatatgcgcgataccattacgccggtgggggaagaccggaagcttccgattgtgatacagacgaatcagacggcggtcgacacgatttcctatgagatccgcagtctcgatgccacacgcctgattgcgaatgcggatgtcacctcctatgaggagcgcagcgggaagatcacggcagatctgcagatccagaatctgctggaagagggcgaagagtatctgatgattatccgcctcgggagcggagaccgttcgatctgttactataccaggatcgcggagccagtcgactgctatgtgagcgagtgcgtcgcattcgtcaaggattttaacgataagacgttcaacgatgagacctccggaacactggcgacttacatggagcggacgaccggggataacacgacgctgcagttcgtgtcgttaaattcttctctaaagcaggtgagctgggcggattttaagggagagcgtctgacagagccggttccgtcaatcaaggagatcacaccgacctacaacgtgatcgtgctcgattatgtggtatccagtgtcaacgagagcggtcagattgaatactataatatagaagaatattacagggtgcgctacaccacaagccgcatctatttgctgaatttcgagcgaaccatgaaccagattttccgcggagaaaatgacagcgtttacgatcagtatatccagcttggaatccgcgaagcgaacgttgaatacaaggcgaatgaggcgggaaccagtgtggcgttcgtgcaggagggagaactctggagctacaatacggtggaaaatacgcttgcaaaagtgttcagtttccgcggttacgagggaattgacagccgcgagaactacggagaacacgacatcaagatcgtcggtgtggacgaagccggaagcgtggattatatcgtgtacggttacatgaaccgcggaattcatgagggggaagtcggaattgcggtctatcattacgacagcctggcgaataccgatgaagagctggttttcatcccgtcagataagtcgtatgaggtgatgaagtcggagctcgggcagctcatgtacgtaaacgagggcggagagcttttcctgatgctggacgggtgtgtctacggaatcgatttaaatactctctcagtgcgggaactggtgacggatctgaatgtacaggattttgcagtgtccgcgtccaaccactattttgcgtggatggagacggagggggattcccagatgggcagcagtgtgatccatgtgatgaatctgtcggatcagagcacgcaggagattgcggcgggcaccggggaagccatcaagccacttggattcatggacgaggactttgtgtacggcattgccagacagtcggatattttcgaggacgccgccggaaatgtgacatttccgatgtaccagatccggattgtggatgtctcgacaaaagatcttaccgtgcagaaaacatacgaaaagagcggctattttgtgagcggtgtgtcgatcgaggactacacgatgcacttgaaccgcatccagtataacggcacggcatatgtcccggcggatcaggatatgatcatgaaccgcgagggagattccggaaaacttgtcaatattgcaacaagcagttcggcggaaaaagagaccgaggtgcagcttacgattgccggagcgtccgcggaaaagacgccgaagcttctcacgccgaaggagacgattttagaggaagagcgcacggtggcaatcaaggaagagggcagcacaaagcactattatgtatacgtgaaaggtgatgtggtgctggcgacagacgatgtcacagaggccgtcacggcggcaaacgacagcatgggagtcgtgattggagataacctccagtatgtatggaaacgctccagaaagtccgcacagccggcactgtcggatatcgcggtcggtgcggaggacgccggcgcaggaagcattgcgcagtgcatcaatgccatgctggaaaaagaaggaatcaatatcagcgtgaacgcactcattgagggcggagagacgccgaagagtatcctgaacaatacgatgaaggatatgcaggtgctggatctgaccggatgcaatattgaggaggttctctattatgtcagctgcggcagccctgtattttccatgacaggaagcacggatgcggtgctgatcatcggatatgacagcaacagcgtcgtgatattcgacccagcgctggggacgacataccggaagactctgaccgaggcggatgagatgtttacagcggcaggaaatgtatttttcacatatctggtgaaatgaaagtgcataaaaaagctcttaaagtaggaaattattcgtgtaagtttaacagatttcatgttcttctattgcaaattggaaatagatgggttatattttgagacgtagtacttgaaaagaggaaatggagagattatgagcagaaaagagattgttgtatcgaatgtctcagaggaacatagtaatccgattgcagaactggttcaggttgcctgcagatttgacagtgatattacacttgagagtaacaaccgccggataaatgcgaagagtattatgggaatcatggcatttaacccgtccaaaggaatgacggtgaacatcgttgccgagggcagtgatgaagaggaagcattagtagcaatggaaaagtttttagtatgtgagtagtttttttgatgaggaggagggctctcataatggaaaaaaagacgacagcgaaacttgatgagactaaggcagcagtaaaggcagcagaagcaaaagttgcggcgaaggttgaggagaccaagacagcagcgaaggaagcaactgcaaaggttgtggcaaaagtcgaggagacgaagaacgcagccaaagagacagaggtaaaggcggctacaaaggtagaagaaccgaagaagacagcagctgagaccgcaaagaaaagaaaaccaagaacaaagacagcgaagaaggcagcaaaggaagagcttaagcctgaagtgtatatccagtatcagggacgtgaaggcgtggtagaggatgccattaagaaagtgacagagcagtttgtggcagaaggtcacagagcatccacgatcaaatcacttcagctctacttaaagccggaagagaacgcagcgtattatgtgatcaatcagaaaattgctggcagagtagacttgttttaatacataggcataataaagggactgacgcttttagcgggcagtccctttttggattttgtttagttctgctctgctttgtactttgcaaccagacgctggatgcggtcatacggatttaagagatcgctgatcgagctgtcgtgatttaacgtatcaatgatataagcaatgtatttgctcatgtcgcagttgatataatatggctttgcgagcagttccggtgtctgataggtcaggttggtggttacgaccttgtagattgtgccgcctgcaacagcctcgtcaaagcgctccaggccgttggtgaacagaccgaaggttgcaacaacgaagatacggtttgcctttctcttctttaactcggtagcaacatcaatcatactctcgccggaggagatcatatcgtcgatgataatcacatccttgccctcgacggaggaacctaagaactcatgtgcaacgatcgggttgcggccgtctacgatcttgctgtagtcgcggcgcttgtagaacatacccatatccagaccgagcacgttagccagatatacggcacggttggtaccaccctcatccgggctgataatcatcatatgctctgcatcgatctttaagtctttgacttctcttaagatacccttgatgaactgataagcaggctgtacggtctcaaatcccttgagcggaatggcgttctgtacacgcgggtcatgtgcgtcaaaggtgatgatgttgtcgacacccatagcggtgagctcctgcagggcaagcgcgcagtctaaggattcacgggcggtgcgcttgtgctgacggctctcatataagaacgggatgatcgcggtaatacgtcttgcttttccgccgacagcagcaatgatacgcttcaaatctgcatagtggtcatccggagacatgtggttcttgtaaccgcatacagagtaggtgaggctgtaattggtaacgtcgaccatcagatacaggtcatagccgcggacagactctttgatgacaccctttgcttcgccggttccgaaacgcggcactgcggttgagatgatataagaatctctgcgatagcccttgaacgcagggtcgttctggtgctggtgctgtctcttttcgcgccagccgacaaggtactggtctaccttaagaccgagttctttgcagctttccagtgggatgagacccaatgctccgtcaggcatggtttctaagtttctttcatcgtttggcatgaatggttcctccattaaagaatagttacataggttttattttcaatagattgctctaatgaaatacatggataaaaatgttaacggttgcgctttaagatacggatgtccgcgccgaagagctttaataatgtgtaattgctggatattctggataaaacgcgctctgaataaatatcggcaagctggttcatcccgaggtttgtggagatgatcgtggatttctgccgcagaatgcgttcgttgatacataaaaataactgcgaggtcgtaaaggaattggacagctccgtgccgagatcatcgatgatcagcagatcgcagtcgaaaatattccggtgggaaagcagtgcctcctcgtcccgtttgaacacgcccttgcttaatatatcaaataattggaatgcggtaaagtaaatgacggaatgaccgcggtctaacagctccttggcaatacagttggacaaaaaggtcttgccgatgccggtatctccgtagaggtaaagattggagaacgtgctgtcgaaatgatcgataaaatcgtggcattttgcgacggcatcctttgctgtctcaagggacgagcgtccggttgccggattgatgtcatccgcagaatagtaatcaaaggaaaacgtggaaaaattctcacgttccagaatctcttttaagttggactgggtatagaccagattgatggctgcctgttcaaaacagtgacagcgtctgccgttcacataaccggtatccctgcagtccggacagtggtacaccggcttcagataatcagaagtaagcccgtgctcctgcaacaactgctccttctgcctgcggtagtccgagagcttttcacggagcgtggccagagcggcctcatctccgtctaacagccggcgtgcctgctcgacagaacaggtagcgatcgcgtcatcgatctctttaagtgccggaatccgggcgtagacgtcctttgtgcggcgctcgagctggtgctggctggctaactgtttttcgtcatatttgcggaatatctcgtcatactgtgaattgcttagcggcatctgtttcccctttaaatcagtgtacgttcgtggtcaaaagcatctgctccagttcgtcgtagtcgtaggagcgctgcgtgaaattgttgaacttgtttttggatgctgtattggcggcagcggaagcggaactttttttgcgttcctggtgcaccgcatccagttttgcaatgtcggacagatggtgaacctgctttttgttccagtcggaaagaatggaatccgtgtatttgaagttcggctgatgcagacttgccatggtgcgcttgcatgcctcaaggatgatgtcagagtcgaaaccgtactcgttcgtccagcggctgatataagcgatctcggtggaaaccagcttgcgtccggtaatgccgaacgcgttcatcacggcgtagtacattttgccaagaaccggggaaccctgcttggcctcctcgacggtcgtgatatgctgatctgcccagccaagtgcgactttttctatgtatcggatgctggtgtgattgttgctcacacagctctcaatcaggtatacgatcagctcggtggaaaatccgagcacatcataaaaatagagaagcgtattgatgtcggtggcgcttaaggtgcggccgagataacgctctgcgatgaagaacagctctgcgacggattcattctggcggaaattcaaaatatcgtccgcggaatagctctttttggcaggaactgtctgcgccggtgccggtgtttctgccaaagcggcggaagcaggggcgttctgtaccggtgcgccggctggctctgtctgtcttccggaagtccccggatcagacggggcggcatctctggacgaagaatccagcatgcggataccggtcagattcttatcattgtcatattcaagctgcagcaggtgcatgcgctcccaataggcaagggcacgcttgacatccttctccgtgtgctcgaacttgtccgcgatggaagaaatggaaaaagacgcctgcggcgcattcataaggcgcagcaagtagaggtaaatcttgacgaattccccgttggcatcagacatatattcatcgataaacgtgttggaaacactggttgcagagactggactgtcactgtgtagcttaatatttgccattgaaaccgactcctctttctcaaacgtaacaagcgaaatgtacggcagccgccgacattccctgatgcattatagcacaggaaaactggaatgagaagtatcttttccggaacacatccggcacagacaatcgaccgcagaaatgtggataatgtggataaagaaaacgaatccggtggaaaccggattatggaaacgaaaggtttggcgcaaaagacggcaaagacggcaaaagtgcaggaaacgtgtataaggattatgtaaacaaaaaaatccacattcaaaagttgaagttttccccaattgaatgtggataaagtggataacttatttgccgagaagatgttcgccaacatttacaatgtctccggcgcccatagttatcaacaagtctccgtttacacaattttttaataaaaatttttcgatctcctcaaatgacggaaaataatagcattccgtgccgcgttccctgagcttggagaggatatcgcgggaggagacgccgtaggtatttttctctctggcggcgtagatgtcggcaaggacaaccacatcagcgagggagagcacatcggcaaaatcctctaaaaatgccttggtgcgcgagtaggtgtgcggctggaagcagagaaccagccgtttgtgcggatagttcttggcagcggttaacgtcgcgcggatctccgtcgggtgatgcgcatagtcgtcgatgatggtgacgccgtccacgcagcctttgtactggaaacgccggtcggcaccaccgaagtcggataatccttttgcgaccgcgtcagcggcaagaccaagatcatctgccagcgcaatggcagccagtgcgttggatacgttgtgcatgcccggaacgtgaagcgtgactttcatcagagtttcctgtcctttcatggcggtgaagcttgcacaggctttttcatcgaatgtgatgtctgccggatggaatgtgcagctgtcactgagaccgaaggtaattacctgcggctttaatccggcggtaatctcggtataatccggaatatcgccgtttatgatgatcgcgccgtcctcccgggtgttggatgcaaattggtggaatgaatggcggatgtcctgaatatctttaaagaagtcgagatgttctgcttcgatattcagaatgatgctgtatttcggataaaaatgcaggaagctgttcgtgtattcacacgcttccgacaggaagaaatcggacttgcctacccgcaggttgccgtcgagcgcttttaaaataccgccgaccgtgatggtcgggtcgcacttggctgcaagaaggatctggctgatcatggatgtcgtggtcgtcttgccgtgggtgcctgccaccgcgatggagttgcggtaattgtccatgatctgtccgagcagctctgcgcgcggcatcatcggaattcctttttcgcgcgcacaggcgaattccggattgtcctcgtggatggcagcggtgtagacgacaagatcaatatcatccgtgatgtttgcggctgtctgaccgtagtaaactttgatgccgagatgctctaagtgtctggtcagatcagattcctttgcgtcggatccggataccgtaaaatgctcttcggagagaatctcggcaagcccgctcatgctgatgccgccgatcccgataaaatggatatgtatgggttctttgaaattgattttatacattataattctacctgcctgtttttctttctatgataaagttcattataaccttatcttactgatttgcaaattcttttgggataaaatattttcgacagaaagtgaaagaggagtgtagaaagagaaaagatttgacgaaaatgtcaaaaaatagaaaaatgtactggcaaatttgtgaaaaatgatgtacatgggtggacgattatgttataattataagtgcaaagaggaatagactgactagaaagacgagaggtgattgacgtgattcgaaaagaaatgatagccatgctattagctggaggccagggcagccgcctgggagtgcttacagcgaaggttgccaaacctgcagttgcgttcggaggaaagtaccgcattatcgatttccctctgagtaactgcatcaattccggaattgatacggtcggagttctgacccagtatcagccattacgtctgaatacccatatcggaatcggtattccgtgggatctggaccgtaacagcgggggagtgacggtgttaccgccttatgagaagagcgataacagcgagtggtattccggaacggcaaacgcaatatttcagaatatgaattatatggagcagtatcatccggaatatgtgctgatcttatccggcgaccatatttataagatggattatgaggttatgcttgatttccataaggagaatcatgcggatgtgacgattgccacgatgccggtgccgattgaggaggcaagccgttttggtatcgtgatcgcagatgagaacaagaagatcatggattttgaagagaagccggaaaagccgcgcagcaatctggcgtccatgggtatctatattttcagctgggataccttaaaagaagcgctctatgccatgaaggatcagagcggatgtgattttggtaagcatatcatcccgtattgccacgagaatggaaaacgtctctttgcatatgaatacaacggctactggaaggatgtcggtacactcggctcttactgggaagcaaatatggagctcatcgacctgattccggagttcaatctgtacgaggaatactggaagatctacacgaagagtgatattatcgagccacagtatctctccgcggattccgttgtggagaagagcatcatcggtgaaggaaccgaggtatacggcgaggtacatagttccgtgatcggaccgggcgtcacgatcggcaggggggcagtgatccgggattccattgtgatgaaaggaacaacgattggcgagaatgctatcatcgataaatcaattatagcagagaactgccaggtgggagcgaacaccgagcttggcattggagaagaggcaccgaataagctcaatgcgagcatctattcctttggtctggtgacggtcggagaagacagtgtgataccggacggtgttaagataggaaagaacacggcaatttccggtacgacggacaaggaagattacccgaacggaattcttgagagcggtgaagtaatcattaaggcaggtgactcggtatgaaggcaataggaattattttagctggtggtaataacagccgtatgcaggaattatccaacaagagggcgattgcggcaatgccgatcggcggaagctatcgaagcattgatttcgcactcagcaacatgagcaactcccatgtgcagactgttgcggttctgacacagtacagtgcgagatcgttaaacgagcatctgagctcctccaagtggtgggatttcgggcgcaaacagggcggattgtttgtattcaatcctacagtaaccgtggataacagctggtggtaccgcggaacagcggatgccatgtatcagaacatcaatttcttgaagaagcgccacgagccatatgtcattatcacgagcggtgactgcatttacaagctggattataataaggtacttgattaccacattgagaagaaggcagacattacggtggtatgcaaggatatggcgccgggagaggatgtcagcagatacggcgtggtccggatgaatgaagattccaagattgtagagttcgaggaaaaaccgatggtatccaagtcgaacacggtatcgaccggaatctatatcgtgcgcagaagacagctcattgagatgctagagcgcagcgcagcggaagaacgctgggattttgtgacggatattctgatccgctataagaatatgaaacagatctatggttataagatgaaggaatactggagcaatattgcgaccgtagaatcctactatcagacgaacatggatttcttaaaaccggaggtgcggaaatactttttccatgatgagccgaagatttactccaaagtggatgatctcccgcctgcaaaatacaatatcggttccgatgtgcgcaacagcttaatcgccagcggatgcatcgtcaacagcaaggtggagaattcgatcctgttcaagaaggtatttgtcgggaagaattgtgtgattaagaattccatcattctgaatgatgtttatatcggcgacaatacacatattgagaactgcattgtcgagagccgtgatacactcaaggcgaacacctattactgcggcgacaacggtatcaagattgtatccgagaacaacgaaaggtatgtactgtagagaagggactaaagggggacagaatctatgcagattacggacgtgagaatcagaaaagtcgagaaggaaggcaagatgaaagcggtggtgtccatcaccatcgatgaagagttcgtggtacacgacatcaaggtgatcgagggagacaagggattgttcatcgcaatgccgagcagaaaggccgcggacggggaataccgcgacatcgctcatccgatcaattcggacacaagagagcggatacagactctgatccttcagaaataccaggagacaatggctgctgaggaataataccgggaagaagccggatggcagcttacccaggaaaataaatgcgcacaggttttacgggaaggtaaagcctgtgcgcatttgtttatacgtgcagggatcgggcagcggtgcagaaaactcttgtaaaatctgcaaactaaggtaaaatgaaacgtgaactgtgacaagatcaaacaaaagacagcaggaatcgtcaattacaatagatggcaggaggagtatgatgagtcagttaaaagcagtgatacttgcagcgggaaaagggacacgaatgaagtcggatctgccgaaggtggttcataccatagagggaaaatgtctggtagattatgcgattgaggcggcagagggagccggcgccggtgagatctgccttgtggtcggctacaaatacgagatcgtgcgggagagcatttcgcacaaggacgtaaagtttgtattacaggagcagcagctgggaaccggtcatgcggtgcggtgtgcaaaggaatttctcggggaggaaggacagacactgattctgtttggagatacccctcttatcacggcagagaccttaaagaaattaagggagcatcacattgcgagtggaaatacagtgacagtgctctcagcgatggtcgaggatccgaccggatacggcagaattatccgcgatgcagacggcaattttgtgaagagcgtggagcacaaggatgcgacggaggcggaactggcatcccacgagatcaactcaggtatgtatatttttgatacgaaggagctgcgtgaggcgctggatctgattttgccgaataatgcgcagggtgaatactatctgccggatacgctcacaattattaaggaaaagggactgaaggtggatgcgtatgcgctggatgacccggaggatatcacaggggtcaacgatcaggagcagcttgcggctgcagcagtcgtgatccggcggagaattgcaggcaacaaagcaaagaataggagatagcgatgttcttgatcgtaggtctggggaatccgggcaggcagtatgagcatacacgccataatgcgggatttgatgtcatggatgcccttgcggaaaaatataatatcagtatcagcgaaagtggacacaaggcgcttttcggcaaagggatgatcggcggacagaaggtgattctggcaaaaccgcagacatttatgaacttaagcggcgagagcgtggcggaacttttacattattataagatcgatcccgaggaggagcttcttgtcatttttgacgacatcagcctggcgccggggaacatccgtatccgcaaaaaagggagcgccggcgggcataatggaatcaagaacattattgcaatgaccgggacggagaactttaagcggattaaggtgggcgtcggcgaaaaaccggcgggatgggatctggcggatcatgtgctcggacgcatgagtgaggaagaccgcgcggcatttgaggaagcggtgaaggaatccgtaaaggctgcggagatgatcctggaggatgagattgatcaggcaatgaatgattttaacaggaaaaagcgggagagtcagtcatgaagacattcacacagcccatgcaggggctgaaagaatttgaagacctggaagcggcactgccgaagctatccggcgtcattcagatttccggctgtatcgatgcagctaaaccacatatgatgtacagcattggcaatggttctggaaacagaatcattgttacgtttcaggaacaaaaagcgaaggaactggcggaggaataccgcttttttgatccgaacgctgcctattatccggcaaaggatattctgttttaccagtcggatatccggggaaatgtgctgacagcggagcgtatcaatgccctcaagatgatggcggaaaagcgctcgtgcacaattgtaacgacgtttgacggactgatgaatccgatgccgtcgccggatcagtttatcagtgcggtgcggaaagtggcggtcggggacgtgatcgatctggagcagtttacaaggcacctggcggaactgggctacgagaagaattatcaggtgcagacaagcggtgaattctccgtgcgcggcggaatcattgacattttcccgctgacggaggagaatccgttccggattgaactgtgggatgatgaggtcgattcaatccgctcattcgatgcggaaagccagcggtcgatcgagaatctggatgaggtccacatctatccggcgtgcgaactggtgctgaccaaagaggagcgcgacgccggtattgcgcgcattctggcagaagcaaagcaggtttcggaaaagctccgcggggagatgaagaccgaggaggcgtaccgcgtcaagtctgcggcggaccaggtggcggaggaagccggggagctgggcctctctgccgggctggacgcctacctgtcctatttttgcgaggaacgcgtctctttgctcgattattttggaaaacaggatacgctggtgttcctggatgagacgccgcggagcattgagcgcggaatggcgacggagaccgaattttcggagagcatgaagcagcgcctggaaaaaggctatattctgccggggcagatgcgggaactttttacctgcaaggagattctgggaaaacttgcggggcgcagatgcatctcgctggtggcactcgaccttaagaatccgcatctggagattggaacacggctgaatatccagtctaagacggtcaatccgtacaacaacagctttgaacttctgataaaggatctggagcgttacaaaaagaacggctatcaggtgatcctgctgtcgggatcgagaacgcgcgcgaagcgtctggcggatgatctgatggcggaggggctgaacgctttttattcggaagactacgatcacgaggtaaagcccggcgagatcatgacgggttacggcaagataaaaaaaggatatgagtatccgatgctgaagtttgttgtgatctccgagagcgatattttcggcggcgagaagaagaaaaagaagcgcaagcgcatctatgagggagagaagattgcaagctttacggatctgaacatcggtgactacgtggtgcatgagagccatggactgggcatctaccgcggtattgagaagatcgaggtggataagaccgagaaggattacatcaagatcgagtatgcaggcgggggcaatctctacattctggcgacgcagctggagcagatccagaaatatgcaggcgcgggggcgaaaaagccgaagttaaacaagcttggcggacaggagtggaacaagaccaagtcgagggtcaagggagcggtcagggagatcgccgaagacctcgtgaagctttacgcagtgcgccagaatgaccggggatttgcgttcggaccggacaccgtgtggcagaaggagttcgaggagatgttcccgtttgaggagacggaagaccaggatcttgccatcgcagcgaccaaggccgacatggagagcacgaagattatggatcgtctgatctgcggcgacgtcggatacggaaagacggaaattgcgatccgtgcggcgtttaaggcggtgcaggatggcaagcaggtggcatttctggtgccgacgacgatcctcgcccagcagcattacaacaactttgtgcagcgcatgaaagattttccagtcaacattgatctgctctgccggttcagaagtagcgcggaacagaaaaagacgatcgaaaagctgaaaaaggggcaggtggacatcatcatcggcacgcaccggctgctgtccaaagatgtggtctacaaggatctgggacttttaatcatcgacgaggagcagcgcttcggcgtggcgcacaaggagaaaatcaagcagcttaagaccaacatcgatgttctcacactgaccgcgacgccgattccgcggacgctgcacatgagtctcattggcatccgggatatgagcgtgctggaagagccgccgatggaccgtgtgcccatccagacatatgtgatggagtacaatgaggaactggtgcgggaggcaatctccagggaactggcgcgcggcgggcaggcgtattttgtatacaacagagtgcgcgagatcgccgatgttgcgacgaagattgcggagcttgtgccggaggcgaacgtggcatatgcgcacggacagatgaaggagaccgaactggaaaatatcatgtatcggtttatcaacggcgagatcgatgtgcttgtatccacgacgatcattgagacgggactggatatttcaaacgtgaatacgatgattatccacgatgcggacaatatgggtctttcccagctgtatcagctccgcgggcgtgtgggcagatcgaaccgcacggcgtatgcgtttttgatgtataagcgggataagatgttaaaggaggtcgcggagaagcggcttgccgcaatcaaagagtacacggagcttggaagtggctttaagattgccatgcgtgatctcgaaatccgcggagcgggcagcctgctcggtgagcggcagcacggtcacatggaagcggttggttatgatctgtactgcaagatgctaaacgaggcggtcaaggaagcgaagggcatcgcggtggaggaaagctttgacacgtcgatcgatattgtgatcgacgcctatatcccgatggggtatattccaaatgaactgcagaagctggacatctacaaacgcatcgcagacattgagacgcaggaggagacggaggagatgacggaggaactgatcgaccgtttcggagatccgccgaagtccgtggaaaatctgctttacattgcaaaaatcaaatcgatggcgcaccggctttattttacggaagtggcgcagaagggtgagagtgtccgttttactctctatgagaaagcacggattgatgtgacgaagattccggaactggtggcggcatacggtcagaaggtgacgtttaccgctgatccgaagaatccgtacttcacatatcacctgaaaaagaattcgagggacaagaatgtggacatcaaatcggtggtggagcagttcctagccgacgcaggaggatttctggcggagcgggaagcaccaaaggaagggtaaaaaggtgtagaaagccaattttcgggcaccggtggaccggctctccggcgtcggaaaagcttgaaaaaagtatgaaaaatattgcgacccggagaaaattgcactataatagagcaagactgccatggcaagctgtcatggcatataccaggaggaacctatgagagcaaagagatggagcgcactgcttcttagcggtgttatggcagcatccatgttaacaggatgtggaatgaataaaaatgagacagtggcaacttttgatgagacggaagtgccgcttggagtagcaaattttgcagcgagatttctgcaggcaacatatgatgatttttatgtggcatattttggcgaggacgtatggtcatccgatctgtacaacaacggcaccacgatgcaggacaatatcaaggacagcgtgatgcagtcactgttcgatatgtatacactggaagcgcacatggcagagtacgatgtggagctgacggaggatgacaaggcggagatcgcagacacagcggctgcgtttattgcagacaacagcaaggatgcattggatgcacttggtgcagatgaagagactgtggagcgttatctgacactggcgacgatccagaaccggatgcacacggcgatcattgcggatgccgataccaatgtgacggatgaggaagccaacacaagctcctacagctatgtcaaggtgtccaagcagtcccatacggatgaggatggcaataccgtggagtacaccgacaccgagctcacactgctcggcaagacggtcggtatgtttgacatggacgccaaggcgggcacgctggaggatgcggcagagcagtatgactatacggtgagcagcggaacgtttaccgcggatgacagcacactcgatgaggcggttcttacggcactgcagggactggacgaaggggaggtgtcggatgtcatcgacacagataccgattactatgtagttcgtctggatgagaagacggatgcggatgcaaccgagacgaccagacagaacattatcagccagcgccagagcgatctgtacgacgagacgctcaaaggctgggaagatgagcatgactggatcgtgaaggattccgtgtgggcgaaggtaacatttgacaacctgttcaccacaacggtggaggatacggagactgagaccgtcacggagagtgcgacggaatagaagaaaagctgcggcaatgacagatattgcggcaggagacagcgaagattggctgtaccggtgatcctcgttaaagagcgtaactccggtgttccagcgaaaacaggcgggaggattctttgaaacaaaatgcgagaatttcttctctgccgtttttgccagttccttccgtgtcttggccacgttttgacactccgcgaggatgtgtccgacaagccgcagacaatgagcggactttctggtgcccctagcggcaccgcttcacagacaatataaaaccgcgcgaaccgaaactcgttggcatctgctattgaaaataaggcagatgccaattcaaacatcggcttcgcgcggttatgttttgtttagcggtgccaacaaggggcacacacaaaagtcctaaaattgtctgcggcttgcggacacgcctccggagtgttcaaaacttggaaagacacggatcatcacagctggcaaaaacggcggagttagaaattccgtattttgtgatcagaatcctcccgcctgtttttcgctggaacgctcgcgttatgccctttaacgagcaacagcgatccgacgatctgctgtctcctgctgcatgtctgtcattaccgcagcttttcgttctttacgagcatctcttcgatgatgccctggcagtgggcaccgattttcttcttcgtctctttatccagctcgttcggatagatcggcttgccgtactctaagatgacgtgcgttgcttttaccttcggaaaatgattctctaaaatatcggcggaaccggtgattgccatagggacgatcgcacacccagttttctctgccatcttgaaacttccctccttaaaaggaagcatcaggtcgtcggtcttgttgcgcgttccctccggaaaaatgcacatcgagatgccgttcttgatgtgatcgatgccggcaagaatggtctttaaggcttccttgacgtcatcacggttgatgaacaggcagtagagacgcttcatccacagggaaagaagcggaacttttgccatgtcattcttggcgacgtagccggtcagacccgggcatctggcataggtgatgataatgtcgaagtagcttttgtgattgccgatgtacagaacagcctcgtcctttggaacattttcttcgccgataacggtgactttggttccacagatgaacagaatgacgcgaaacgcccactgcaccatgcgcagctggctgatgtcggcagccttacggttgaacttgctgatgatccattcgattccgaggacgggaatcccgatgatcagatagagaatggcaaacagcagagcaaggatggctcgtaacataagaaggtcctttccgggcaagcgccccgtagatttttacatagtttttattataaatcctgaaaagaggaaacacaagacgcggaaaagagaattcgcaggcatatttaaaaaagacgcggcatatactttggatagaaccgaaaatttgggggactgtcagatgttttggtatgggaagagatggaagaaggggtgtctggtctttttggcagcggcggccctgcttgctgccgggtgcagcattgagacgacaaacggagcgaaggttgccgatcttgactatgagattgtggaggaggcgcagataccggaggaagtgaaggctgtgatagaggaaaaaaaggcggctgattttaaaacgacctatgaactcgacggggatctgtacatagtgcgcgggtatggagaacaggagacgggaggttacagcatctgcatccgggatctgtatctgacgtcgaatgcgattttgttcgatacggaacttgtgggaccgagaaagggagaacaggtaagcagcggaccgagttatccttatattgtaataaagaccgaaaaacgtgacgaaagtaccatatttgagtgaattttcttgatatttttaaaaaattctccggtttgtttgacaaaaatttagtacagtgataaactaaagcggaatggtattcggtgttaggacgataagaagccggaacagggaggtagacaatgcaacaggcagacatccataaggtacgcgcttccgtgtatcagcagtgcggacggaaggtactgattcagcttgacagaggacgcaacaaggtcgacatccaggaaggagtcattcagaacgcatatccgagtgtttttacaatactggtgaatgacgagcaggaagaaaatccgcctcagttactttcattcagttattcggatatcattacaagagatattcggatgaaattatgttaacataaggtatcaggtataatattccccgtattcgaataagatgtttcaaagattcggatatgggggatatttttttggaactcgaaaaagtaaagatacatagaatacagcagaatggcacggcggtcagccagatcacgctggatgatgactataatgtcccggactaccggccggacatcatgaaggttttgaaagaaaatggcgaactgcggtttgacgaggtgaaggcggcaaacaaggcggtgtgggtaaaaggaagcctggtgtttcacattctttaccggtgtgagcagagtgatggaaaaatcagctgcctcaaaggagagattccgtttcaggagaaactcaatatagacgggctgcaggagaacggggaggtacatgccgccggagagatcgaggatctgacagtcggcgtaatcaattcgagaaaattgagcatccgtgcggtggttgtgctgcgtgcctcggcggaggaacaggtgttggaggagtttacgtccagactggaactgccgggggattaccagcagaagacgggaacctggggagcgctcaatctgctcgcatcctgccgggatgtctgccggcagaagagtgagattgttctgccgtcgaacaaacccaatgtgcgggaaattctgtggcgcagtgtagaactccgcaacgtcgaaagccatgtggaggatgggaaggcggtcgtcacaggtgagattctggcggcggtgctctacagtgaggaagaggagagcgagcgcctgcagtggtatgagacgacggttcctctggaatgtgcggccgactgtgacgctgccggggagaattgcatttttaaaatatcggctgtcccgctgtcggcggaactggagatcaagccggattacgacggggaggagcgcattcttgtgctcgaactctccgtctcggtcgatgtccgcgtgtggcgggaagaagagatggaacttctgaccgatctctactcgctccgggaaaaagccgttccggtagtcagggagcggatcggtgagagactccttgtaaaaaatgcggcaaaatgccgggtaacggaacagctggaaattccggaaagccaggagaaaatcctgcagatctgtgcctgcgagggaacggtgcgcctggaaaaatacgagcctgtggagaacggaatccgggcggagggaacgatcacggcggaacttctctatatcacaacggatgacaatatgccgatccagtcggcaagggaaatctatccgttttcccagatccttgagattcccgatatgcagccggacgtggaggcggagatggactgcggattagagcagctgtccgcggtgatgatggatcaggaacatattgagatcaaagcggtgatccagttaaacctgatggcgtttttgccgcagaaaatacagaacatcgaagagattacagaagagcctttagatatggaagaattacagaaccgccccggtctggtgggctatattgcaaaggcgggcgatgatctgtggacgattgccaaggagaatcatacgaccatacaggatattctggaaaccaacggctggacggaaaaaaatctgcagccgggagatgcggtgctgatcgtcaaacagataggataaaggtactatttgcacagatttgcttgagtaatagaagacgctctgttatactaaagtggttatgagtgttattttttgaaagaattttgaaaacagggagacaaaagatggatcagaatgagaacaaaaattacaatttagagaacgacccgggacagacacagctgggatctgcgggggcagagaatcagcagggaacgcaggatgtgtacggtcagccgggagcacagggtgcatacggtcagccggacgtggcagcgaatagcggaatgacgcagccggatgcccagccgggagcgaatgcttacggccagccgggaaacggttatggacaggaaagcgcaggtcagccttatggacaggagaatgcaggccagccttacggtcagaactacggtcaggcagaaaatgcgaacggccaggggaatgtgagccagccttacggtcagcagaattacggagagcagagcacgaacggccagggagagtattcttacggacagaataacgcctatggacagaataacgcctatggacagaataacgcttacggacagaataatgcctatggacagcagacgaacggtcagcaggcgtatggtcaggcgaacggccagtatgcgggaaatgcatatgccggcgtaaactatggcgaggcgacggtgctcaacgacgagaacggtcagccagtgaagaactcgttcggaatgaagattacattctccatccttgagattctgtgctgctgcggatgcaacctgattaccatgattatgggtattatcggatgcgtattcacgagcaaggcgaacagtgcctacaagtccggagatgtgcaggagtataagcgcaacagcaagtcggcgacaatctgcctgtggatcggttttgcgatcgcactggtatggctggtcttcagcattattttcagcgtactttacagcaacgacatcgaggatgcgtttatggaaggatataacgaggccgcaggtgtaagcgatgattacgacacggatgatttcatgggtgattccggtgatgaagagtacgacaccgacgattttcttgccgatgacagcgaggatacagaggatgccaaaacggcagctccgcttgacgtgacagcaggggatgcgttcgacagcggagacattaccgtcaacggtatcctggtgcagcttcctatgagctacagcgatttcaaggcactcggtttttccatcgactccgaggatgaggagtatgtatccaacaagaatgaatattactatccgacattctacgatgcacagggaaatgaactgggagaggtgtacattggaaatgtaaccgacgatccgcagacacttgcagacggaacggtgttcggcttctcattcaccagcatggactacaatgacgatctggagatccttctgccgaacggtctgacaaaggatgcggtcaacgacgactttatgactgcttacggcgagccggattatgagtatgagtcggataccggcgactaccagtcttatcagtggtacagccacagcgacacctacgaggatatggatgaaaactccatttccgtaacattctatgatggcgagctgagcgatctggaactgatgtatatcggatgggattgatctgatttccgaaaaatcgaaaaattatggaaactgtgacaattttataaggaagtatgatataatcaacgggtatgataacagagtcatacccgttttttgtacgcaatgaaagataattcagatatttgggatggagataccgcatgagacattttaagaaacgtgttctggcactgcttctggcgggagcagtcggaatcggaaactatgcgtctgtgtctgcttcggcaatcaaggatgcacaggataaaaaggatgaggcacagcaggaactgaatcaggtgaaccagcagattcagaatatccagtcggcgcagaacagccttcaggcagagatgaataattatgacaatcaactcatgagcctgcttaccgatatggacatcctgcagagcgatatggatacgcaggagcaggagatcgaacaggcaaacgcggatctggaaaatgcgaaagcggaggaacagcagcagtatgacgccatgaagcagcggattcagtatatgtatgagaatggagaccagtcctttttgacggcgttagtcggcgcggacagcattacggatcttttgaaccgggtggaatatgtctcggacgtctaccagtatgaccgcgatatgctgacgaactatcaggaagtggtgcagcaggtggaagatctgacggcacagcttgagagtgagatggcggagatggaggagcttcagatcagctatcaggagcagcagagttctctggagcaggtgattgcgacaaagcgttcggagatggcggattttgacagccagcttgccaatgcacagagtcttgcaagccagtatgcgcagacgatcaagcagcagaaccagatcatcgcgacggagaaggcaaaacaggcggctgcggaggcggcgaagaaaaaggcggcgcaggcggctgctgcggcaggaacgaccggcagcaccaccggaacggatgcctcgacagccggcaccggaacgacctcgaatacgaccggaaataccgcttcgacagggacggatacctcgacttcgggcagcagtacctccggcagctcttccacaggtctgacggacggcggactaaatccgtcctacacgaccggagtcagcggcagtgacgtcgtgtcctatgcgagccagtttctggggaatccctatgtccttggaggtaccagcctgacatccggaacggattgctcctattttgtcatggcggtctaccagcattttggcatttccctgccgagatcttcctattcgcagagcggctgtggacaggcagtcagctatgaaaatgcgcagcccggcgatattatctgctatccgggacatgtggcaatctatatcggcggtggacggattatccatgcgtccaacccgagaaccggcatctgctacggaaatgcaacctaccgtacgatcacttcggtacggcgtgtgttgtaggtttgtattttcaaaagcaaaatgctataatctggatagaaatgaaataagagatggaggaataaaaaatgcagttcaaacagttacaggatgatatgatcgcagcaatgaaggcaagagacaaggtgcgcaaggatgcaatctccacactggtgtcggctgcgaagaaggtggcaatcgatgagggctgccgcgatgacattcgggaagaacttgtggaccgggtcattttaaaggagatcaagtccgtgaaggaacagatcgatacctgcccggcatccagagaagatctgcttgcagaatataagacgcgctacgatatttttatggaatatgcgccgaaaatgatgtcggctgacgaggtggaggcgtttatcacagagaagttcgcggacgtggtagcaagccacaacaaaggacagatcatgaaggctgttatgccggaactgaaaggcaaggcagagggcagcgtgatcaatcaggtggtggcagggctttgtcaggcatgagacagaaattaagatttactgctgttctggtcgttctggtcatcattctggggacagcatcctaccgcgaacagggaaagcggcagaagctgtcatttccggaatcactggatcttgtggtggtgacggtggacgggaagacggtaactctgcgggagatggcattttatatcgcatatgaggaaggcaatatggaagatgcggccatcatctataatccggataatacggacgaatactggcagctgtatatcaatcatacgttcctacgggagcaggcgaaacagacagtggtggatatgaccattcatgatacgctgttttaccagatggcaacagcagagaaaatcacgctctcagaggaggaggaacagtatcttgccaatgatcagcaggatttttggagtgaccttaccgaggagcagagagcgcgcctgggtgtcgatgaggaaacgattgatgcatccatgcgaaaaatggcgctggcgcagaaatatcagagtattcttgcggagatggaacaggtcgattacgaggattattccatcggcggcacggaatacgaaaaacttctggcacagcatacctgtgagttagacgagactacctgggaccgcgtgccgttcggcagcatcacggtagatcattgaacaaagagggaaagacagagattttccattgcgtgaagcaggatatgcgccgatatgtgaagaaagcatttgcggcaggcagaatataatataaaaaataaaatagagaagagaagaagaatatgtcagtaaaaattggaagaaatgatccgtgctggtgcaaaagcggccggaaatacaaggcatgccatcaggcatttgacgagaagattgcagcgatcgctgcgcagggacatatcgtcccgacccatgacattatcaagaatgcagatcagattgcagggattaaggagagctgcaagatcaatatcgcggtgctcgattatattcaggagcacattcatgagggcatgaatacggcggaaatcgacaagattgtctacgacatgacgaccagcatgggcggtattccggcaccgctgcattatcagggctacccgtacagcgtgtgcacttcggtgaacgatcaggtgtgccatggattcccgtcaaaggatgtcattttgaagtcgggagatattatcaatgtggatgtttccacgattttgaacggttatttttccgattcttccagaatgttctgcatcggcgacgtcagcccggagaagaaacgtctcgtggatgtcacgaaggagtgtgtggaaaaaggtctcgcagaggtaaaaccgtggggatttttaggcgatatggggcaggcggttcacgatcacgccttcgcaaacggttatacggttgtgcgtgagatcggcggacacggcgtgggactggagttccatgaggagccgtgggtcggctataatagcaagcgcggtcaggagatgctgatggtgccgggcatgatctttacgatcgagccgatggtcaacatgggaaaagtggacatctatgtcgatgatgcaaacgactgggaggtctacacggaggacggacttccgtctgcacagtgggagattatggtgcttgtgacggaggacggtcacgaggttctttgctggtaagcaggaggcaggatgaaaaagctgggaaagaaagcgggaaaagcagcttcgatgaagaaagcgggacacagagcagcgggaaaagcggcttcgatgaagaaggcggggcacggaacgctgggaaaagcagcggttctggcgaacaaggccgcgcaggagaaaaaggcagatgtgccgggcgaatggctctatcttgcaccggagactgtgggcgtgcggcagattgcagacgtgctggaaggaacctgtgagatggaaatctggcaggaagcaggcgtacttgagattatgtacggcggagaagcctccatggacatggaggaaggaaaaatacatccccgggatcaggtgactgcggcatttgcagaggaacatgactgcgacagagtgtatctggtgacattttctgcggaggaatatgaaaaggtactgcctgtaatgcggcacatcttacaggaatgcggcggcatattctgcggcgatacggaagattttaagccgatacttacagagtagaaaagggatgcttttttgctttagtgtattgaaatgataagaaaaaacagctatgatactgttattggcgcagagagaaaaagggcgccggatcatggaggaaatatggacagcagaatttcaggacacacaggattattggcattgattggttcgccggtcggacattcgggttcgccggcaatgtataattacagcttcgagcggctgggactggattatgtgtatgttgcttttgatatcaaggtggaggaagtggcagacgccattgccgccatgcgcacattcaaaatgcgcggctgcaatgtcaccatgccgtgcaagacagaggttgtcaaatacatggatgaattgtctccggcagcacagattatcggagcggtcaacacgatcgtaaatgacaacggcagactgaccggccatattactgacggcgagggatttgtgcataatctgaagaatcacgggatcgatattaagggcaagaagatcacggttgcaggcggaggcggtgccgctactgccattcaggtgcagtgcgcgcttgacggtgcaagagaaatctctattttcaatatcaaggatgctttttttgagagaacgctgaaaacggcggagaagatccgtgcggcggttccgtcgtgcgtggtaaatgtctatgatattgcggatactgcgcggatgactgcggagatcgcgtccagcgatatttttgcaaatgcaacgattgtaggcatgaagccgatggaaaatgagagtgtggtaaaggacacttctgcattccgaccggggttagtggtggcggatgccgtctacaacccggaggagacgagattgctccgggaggcgaaggaagccggagcaacctgtatcggcggcaagggaatgctgctgtggcagggcgtggctgcctttaaactgtataccggaaaagatatgccggtcgaggaagtcaaagagcgtttttttagctagaaaggtgaaactgcggcatgaagaatttatatctgatcggctttatgggcgctgggaaaagtaccattgcgagagcgcttgcgaaaaaatgtccgtcgaagcgaatcgagatggatcagctcatcgaggaacaacaggggatggcaatcacagatatttttgccgcacatggggagaattatttccgcgacctggagacagagttgttgcggtctttttcggagagcacaggatatgtggtatcctgcggcggaggcagtgtactcagggatgagaatgcggcgctgatgaaggagaacggttgtatcgtgttccttcgggcgacgccggagacgatctacgaaagagtcaaggacagcacgaaccgcccgattttaaacgggaatatgaatgtggaatatatccgggaactcatggagaagcgccggccgcgctacgaagcggtggcggatatctgcgtggacacggacggcaaggacgtggatgccatcagtgaggagatcctgaaagcggtagaagacagatcataagaggggcagcgggagatgaattttgagtttataagagagtgcaggctggagtcggacgagcttcaggcgatgtatgacaatgttctgcaggaactggagcgcgcggagcattattattggagaaaaccgcaggaatgcggcatcattctgcgccagacaacagagcggatctgtcgtatctataatacatattatcaaatcggctatccggggaacgcttcgctggaagagtttttgtgttatacggacgaaaacgagcacaacgtgatggtgagccgttttctgagcgtcgtccgcaaggagcagcgcgaccggctgaataagctgcgtgtgctgggggatgactgtatctggggcgaggaggcaccggatcaggggatgacttttgaagaccgcatggggcagaatgcaagacatatgatggagaccatgatggaggtcaccaaggatatgtgcgagaagatcaacaagagggacgatgtgtttgacgagttcttcctcgaggaggctctgccggagacgaaggaagaggcaggaaaagaggcacttgccgctgcggagataacaaccagtgcagagaatacgaaaaaatctttgtttgccagaattttccacaggtgaggacaaatgaaaaaatcagtatcgatcgtttatggagtgctgcttgtcatcggattcattctgatggcgttgagctttgcgtttgcaggtaaaaagaatacaagctttgcggaggattccagacgaatcgaactgcagcccgatcgcgtggtggaagtgagtgaagatgtcagggagtattatttcgacagtaatcagatgcagtcggagttttcggaactgacattttttagcgtacatcagtgcgtggaagtgtatgcggacggcgagcagatttattcgctggaaaagagcagtacggtgttcgggaggacgcccggaaccggatggaatacgatccagctgcaggagggcgtgaagagtttcagtgtgcggatcgaggcggtgtacccggcagtgcgggatcatgtgacgaggttctatcaggagaatgacggacagatggtctatcagacgatgagaggatcggttccggagatcatggtcagcacagttgacggagcgatcggtattatgctgctcatttattatgcaattgcaagacgcaaagtaaagatgggaccgggcatcctgtattttggcatttttaccctgatgatgggaatgtggtccatgaatgaggcggagctggttgcctacatggtaaaaagccggacggcggcctcgtacgccggttatatgctgattatgctgatgattgcgccgtttgcagcatttttgcaggagttctccgaggtggaggagaagtatatatcaaatattatctgcatctgttcatttgcgaatgttttagtgtgtaccgtactccacatgacggggatctgcgagtttaaaaatacggtattttgcacgcattttctgatggcatgtgacctgctctatctgctctatgtgatcttgcagcgttaccgggcgcgcggaatggaccggcgggtacgtgtctgtatctggggacttgtaattctgctagtgtcttacgcggtcgacatgtcggcgtactacatcggatggagaagaacggatgtgatcggcagatttggattcctgttgtttatctgcctgctggcgagagaggcgactgcggtgtcgatggagaagattgatgagggacgcaaggcggagatctaccgggaactggcggagcatgatatgccgaccggactgtacaaccgcaacgcttatgatgagtgggcgtcggaaaatgccagagaccgagagacggcgattgtaacgttcgatctgaatgatctgaagtactgcaatgacacgttcggacatgcggcgggcgataagtatattcaggatgcggcaaagctgatcgcagaagtgtttgaacctgccggggtgtgctaccggatcggcggggatgaattctgcgccgtgatccgccatgccagaagtgagtgggtcgaggaacgtctgcgcagactggaatgtctcgagcggaaatataatgaagggaaaacggacgtcccgatgcggatcgcttacggctacgcgatctttgacgagcagtatgataaaaatatggaagagacaaggaaccgtgcggatgtgaagatgtacgagaaaaagagagcgatcaaggcggaagagagaaaatgaaaaaatgcgggaattcccgcattttttctgctgtagtcagaagttgcttccgttccagccccagttgtcagtcgggaagtatgccacgtagatgtggtcggcaggaatggaaagttcgccggagagcagatggcagagctttccggtcatctggctggtgcctgcagcggacggcgtgccgaagcttttgacctccacataagcgacagcggcagaatccccctgaaagaacaggctggcattgtcctcaaaaccagtcataacccagttctctcccttgccgagacactccctggtaatgcggcagatctctgcggtcagggaatcctttttggatttgctcagggaaacggtggttttcgtattgataaatggcacggcaatatcctcctttacatctgataaagatagtatatacgaaaataagcctgcatacaatgtaaaaacaagtattgcaggggatttcgtttgaaaggttatattgaggaaagagctatggagattgccagatatatcattgacaataacacgaccgtgcggcaggcggcaaaacatttcgggatcagcaagagtacggtacataaggacgtcaccgagcgccttgcgcaggtcaacccgtcgctcgcggcggagacgcgcaaggtgctggacatcaacaagtccgagcggcacatccgcggcgggatggcgacaaaggagaagtatctgcatcagcatgtgtgaaaacgcagaagcatttgacggcatgaaaacgtttttatataataggagaagataacggcaggatagatggaggataagcgcagatgaagaagatagcgttgatcatggatggatggaagcgattcttcacatatgcatggcccgccggagtgttggagcgtatcagagagacgaatgaggacgtgaatctgtatattttcaacagttccggagactggagcagggatgaggattacaatatcggagagtacaacatctatcggctgccggacttaaacgatttcgacggcattattgtagatctgaacaatatccgctattccgaggtgcgggagtatgtgatctcctcggcaaaggccaccgggaagccggtgatttctattgcaaatgagattgcggatttttactatgtcggtattgacaactattccgccatgcaggaaatagcggcgcatctctatgaggtgcataattgcagacgcttctggtatgtcatgggaccggacgataattacgagagcaaccggcgtgtggctgcgttgcgcgatttttcagagacacacgggattttgtgggatgccagggatctctactgcgagagttatgaatacaagtgtggagtgcatggatttgaaaaattgctcacgctgcacgggaaacttccggatgccattatctgtgccaacgataacattgccgtcggcgtgtgtgagacagcggcagcccacggttacaaggcacccgacgattttctggtgaccggattcgataattttgacaaggcgagctattattcaccgcacatcacaacggtcggacatatccgcgagcaggtgggataccactgtgcggatattcttctgcggctgtggaggggcgagatggtaccgcggtttaattatacggggcaccagtgcattttctgggaaagctgcggctgcgacgccggcattgcggtggatcaggcagaacattccagggcgcagattgtctatggaatcgagacggacgaatttgaggagcaggtgctttcgctggagtatgaattgttgcagtgcgagacggtgcgtgagatgtcgcgctggattccgaaatgtattccggctatgcggtgtgacgcgatgtatctgatcatggatgagcacatgaatgatttccgggaattgagcgattattatgacagacatctgattgaggatgaagagttctgcgtgcacggttatccggagaaaatgcagatggagttcgcctatgaggacggtgtggtaaaagagagcgaggagacggtcgtggaggggattttcccgaccttcgattacacggagggcggaaaagattttctgtttctgccgcttcatttccgggaacacacggtgggatattttgtcatccggaatgctgtgtatctgatggagaagcagtatctgttccaggttatcaacgtgctgacgtctgcgatggagaatctgcataagaaggagcgccttgcctatctgaatcaggtgctgtcagaactgtacgtgaaggacgccatgacgggaatgtacaaccggctcggttaccagaagctggcgtgtcgtatgtttgagaaaaagaagctgacgggggagaatctttcaattattttcatggatatggacaggctcaaaagcatcaacgatgaatttgggcatatccatggggactgggcgatcaagacgattgcgtcggcgattttaaaatatattccggagggagcggtcgcggtccggagtggcggggatgagttcctcgttgtgctggagcagactgcggatgcagagatcgggaagatcatcggagagatccgggaggagatccgggaacgttcggcggagatgaaactgccgtttccgctgacggtcagtgcgggatgtgtccacacggatatgacgaccgtgcgcgatctggacgactacgtgcgtgaggcggatgctatcatgtatgaggagaagaccgcgaaaaaggcgaaccgcacctaagcaggatgaaaaggcttccaaccgggcaggggaaaagaataagaaagtcagaaggagataccggcagatgaaaatcgagcgtgaacgggtcagagaaacattccgggagtatacggatgcttatgatgcgaccgatgagaaaataaaattgaaaattgaccacacttaccgggtggcggaactgtgcgagcggatcgcgaaggcagagcagatggagaagacagaggttgatctggcatggcttcttggaatgctgcacgatgtgggaagatttgagcagcttcggagatatggaacattcagtgatgcagattccattgaccacgcggcactcggagcggatattctgttcggtggtccgctgtctgcgggggaaggtctgatccgcacgtatgtggacgatgcggcggaggatgaggtgattgagactgccataagagtgcacagtgcctaccggattccggaggggcttgcgccgcgcacggaaaagctgtgccatatcctgcgggacgccgataagatcgatattctccgggtcaatgtggatgtgccgctggaggagatttataataccacgacggaggaactgcgcaatgcagccgtcacaccggcagtgatggatagcttttacgaacatcacgcgacgctgcgcagtatcaagcgcacgccggtggatcatgtggtggggcatatttcgctggtgtttgaactggtatttccggagagtgtgcggattgtaaaagagcagggctatctggaaaagctgctgcattttgagagccgcaacgctgtgacaaacgcgcagttcgcagagcttcgggcggagatggagcgctatcttaagggaaggtaatgtctgctccgtggtttggaaaaatgagcgcagccgcgcagtccgcggcaaagagcagcagaagcagggtgtttaatccaaggcgcactttgggggtgagtcgtttccagagcctggtgagcggcgcctccagcacacagatccagagcacgcccgcgatgccgaagccgaccgccgcgtacaggcagatatagccatgaaaatgaaaaggatagccgctgtaatcccagtagcgcagattccagaaggtatccagaaaccatccgatcaggagttccagaccggtgccgatggcagcactgaggaaaaagacgccggccgggtggattttttttcgcctgcatcccagcagcagatagaaaagcactgcgccgatgccgtagaccggaagccacggcccgtagaggaagccgcggttggcaaaggttttgtcccgatacaggaagatggcaacctcccagagaaacccgccgatcgagccgagaaagaagaaataaatctgctgggagaggaaaaacgatataggagtctgctccggtgcgcagagtttggaaaaatccggaagacggtcatgttttttcatggagatagtataaccggaacattgaaaattattgaattgtgaaatggtggaaaatatagaaatgcgccttgtaaattgcgggagcgtatcttataatagtagcaattgagcaaaccgccctttgcggcggaaaaacatcaggaggaaaagagtgtggaaatgaacaacaatttttcacaggaaaaagtcattgtcatcgactttggcggtcagtacaatcagctggttgccagacgtgtcagagagtgcaatgtttactgtgagatctattcctaccgtacagacatcgagcagatcaaggcgatgaatccgaagggtatcattttaaccggcggtccgaacagctgctacgagccggattctccgacgtacacgaaggaactgtttgaacttggaattccggttttgggactctgctacggcgcacagcttatgatgcatgtgctgggcggaaaggttgagaaggcaccggtgcgtgagtatggcaagacagaggtgtttgtcgatacgacatcgccactttttggcgatgtgtctgagaagacgatctgctggatgagccattttgattatatttcaaaagttgctccgggattttccattgcggcgcacacggcagactgtccggtggcggcagcggagaaccgggagaagaagctttttgcaatccagttccatccggaagtgcttcacacccaagagggcactaagatgctgcacaatttcgtgcgcggtgtctgcggctgtgccggaacctggcgcatggatcattttgtggagcacacgatcgaggcgatccgcgagaaggtcggtgacggcaaggtgcttcttgcgctgtccggcggtgtggattcctcagtcgcagcaggacttttatccagagcgatcggcaagcagctcacctgcgtgttcgtggatcatggtcttctgcgcaagaatgagggcgatgaggtggagagcgtatttggcccggacggtcagttcgacctgaattttatccgcgtcaacgcacaggagcgctactatgcgaagctggcaggagtgacagagccggagcagaagcgcaagatcatcggtgaggagttcatccgtgtctttgaggaagaggcgaagaagatcggtgcagtggatttcctggcgcagggaaccatctatccggacgtcgtggagagtggacttggcggggaatccgcagtcatcaagtcgcaccacaatgtcggaggtctgccggactatgttgatttcaaggagatcatcgagccgttgcgcaatctgttcaaggatgaggtgcgcaaggcaggtcttgagcttggcattccggagaacctggtattccgccagcctttcccgggaccgggactcggcatccgcatcatcggcgaggtgacggcagacaaagtccgcattgtgcaggacgctgatgccatctaccgcgaggagattgcaaaagccggactggaccgttcgatcggtcagtattttgcggcgctcaccaatatgagaagcgtcggcgtcatgggagacgagagaacctatgattatgcagttgcactgcgtgctgtgaatacggtggatttcatgaccgcggaggcggcggagatcccgttcgaggtgctgcagacggtgatgagccggattatcaatgaggtgcgcggggtgaatagagtattctatgatctgaccagtaagccaccgggaacgattgagtttgaataacggactaaaatgccgaaagcctgtatttatgcgggtttccggcatttgttttatcaaatggctctagtttggctctatttgtgggcgcaataatggcaagaaaatatatgaaatctaataaggagcattatatgacgaaagtgaatttttatgatagtgttaatgattcaatgctgaagtttgcagttattattgccagacataatggtaaatgggtattttgcaagcacaaggaaagaaatacatgggaggcaccggggggacatagagaagatggtgaggatattcttgaaacagccaaacgagaactatatgaagaaacaggggcaataacttttgatattactccaatttgtatatattctgtgactgcaccagataatttcgatggaatggagacttttggaaaattattcttctcagatatacatacatttgaaaaagagcttcacagtgaaattgaaaaaatagtaattatggatgaactaccgattaattggacttacccagaaattcaacccaaactgctggaagaagcaaggaaaagaggattttgcccaaaaaggacgaaataaaatggctattttttgatgttggatcgacattggttgatgaaagcaaagtttatgaagacaggatgaaaaggatagcggatttatcaggtttaacttacgagcaaatttataaatatgccatgtcgttttataaagaaaacaaaaaaggagatttagaggtagcaaggcaattgggggtgaaattacctaaatgggaatcgcaatacgagaggctgtatacagatactaaagattgtttgaaaaagttaagtagaatttataaaattggtgtaattgcaaaccaatcattaggaacttctgagagattagaaaatcttggagtacgaaaatatcttgatttgattatcgcatcagcagaagaaggcgtttcaaaaccagataggtgcatatttgaaattgcattggaaagaagcagttgtaagacagagaatgcagtcatgattggtgaccgtattgataatgatattgtacccgcaaaacagttgggtatgaaaactatatgggtaaaacagggatttggaagtttgtggaatataacagatgagagtgaaaaagctgatatggaaattaataacttatctgatgtattaaaatatttataggggatgagtctataaaataagattcaaattacaatattgcagaacatatgatatatgttagggtactctttaaggaaagtacccatgacagggcgttaagtgtctgggggtgcttgcttagcgccgatgacggcttatgagatcatttcgattttcattgggatattagcattgttgatgtcctttggtagcttgattatagcgttgcttgcctttctcgataaagagaaaaacttttcgaggaagagcaggcgaaaataaaaatgcctatcctctctgcgaacaggataggcggtgtccttaaggacattcattttcacatatatggcaggcttttaatgaacttgtagaaaatggacaacttatttcaagttcggaaatatttgaagaattaaaagatgatgatattgtaaaatgggcaaaggaacacaaagatgcttttttgcctttatcaaaggaagtacagttaaagactacagaaatattacaacaatttccacaaataataaaaattcaaacaaagggaagctcaaatggagatccatttttgattgcaacagctattttagaagatgggattatagtaactgatgaaggaaacaagaataatggaattccaatggtatgtgaatcattaggtatagagtatatgaaacttaatgatatgttagatgaggtattggagtaatgaattagaggggagagatccttctcttttttgtttgtattattccgataaacgatgtataatcaaactagttttatgtttctacttatgtatgattttgaagaggtaagattatggagtatttaacgactgtggaattatcagaaaggtggaatatcacttcacgtcgaataggtgttttatgtgcagaaggaagaattgaaggtgcaataaaaaaaggaaaaacatggttaattccttcagatgcaataaagcctgctgatggacgatacaagaagaagtcagaaaagtaagatgtaatacgaaatagaatttataaatatatgagaatatataattaaatgcagagggggtactgatatggcatttgattttgaaaacgcaaatgaagcacagagaagtgctatttcaacaacagatggtccgttgttgattattgcaggccctggtacagggaaaacatatacattagtaaagagaattgtttatcttataactgaaaaagatgtgcttcctgaggaaataatgattgctacatttacagaaaaggctgcgaaagaactgattacacgtatcacaaatgaattgtatgcaataggagtatccgtaaatctgaatgaaatgtatattggtacttttcattcaatttgtctgagaattcttaaagatcatcttgaatatacaaggattaagaaaaattataggatgctggataattttgatcaacagtatatggtgtttcaaaagattaatagatttaggaacttaccttattttgatgttatatttgataaaaagcaaggagcttggagacaagccggagaaatagttaagtatgttaataatcttgctgaagaattggttgatattgatgaaatgcagggagacgcggatgaacatattgtagctgttgcaaatattatgaaacagtacaatatcttgatggaagatgagaatttaattgatttttcaagtattcaaacagaagcatataaattattaatcgaagaaccaagtatattggaagaaatacagcagaaaattaaatatgtgatggtggatgaatatcaggatacaaattacatacaggaattacttgtgtttttgattgccggaaaaaataaaaatatatgtgttgtgggagacgatgatcaaggtttgtatcgttttcgaggagcaacaataagaaatatattggaatttccaggccattttgcagaaggagaatgtaagcaggttaaacttgttacaaattatcgttcagagagacaaattattgatttttacaataagtggatgagcacaacagatggtagagcatatgattttatgtggaagaattttaggtttgagaagaagattgttccgccggaagggaaaaaggctgctaaagtaggcgttattaaatgttcgggaaaagatttgttagatgattggtatgaacaagtgtattcatttattacacaattaaaaagtagtggtgtactaactgattacaatcagattgcagttctttgcaagtctgttaaaggggataaaatcataggtatggttgaatatcttgaggaacatggtattaaagtttattcacctcgttcggaaatgttctttgaaagaaaagagataaaacaggtaatagggtgtatgatcttatgtttcccagagtatgttcgtaagttacaacaaagagatttttcgtatgattttgaaaatctctataaatattacgatactcaatgtatagctgctgcaagagagctcattttacagtatagagatacattgggtaaatggattgcagagaagatgcataaacacgctaatctaaaaaaggataatgcagattacgcatttacaggattactgtatcagttattgcagtttgaaccatttagtacatacttagggatagatatgaaatcaggggtgatagatgaaagacctgcaagaaacttatcaattttatcgtcaattttgggaaagtacgaatatctacatcggatagatgtcttcacggaaaacaatattatagagtcggtagaacgtttttttaatatgtattttcgctttttatttgatggaggaattacagagtatgaagatgattcggagtatgctccgagtgggtgcgtttcatttatgactatacatcagtcaaaaggaatggagtttccaatagtgattgttgattcattaaatggaacaccgagaagtagtggaaatcatttgctagaagaaatagaaaataaatatttccatagaaaagtttttgagacgagggaagatataaaattttttgatttttggcgattatattatacggcattttcaagagcacaaaatttattggtactctcttgttgtgaaaagaaaggtcatggagccacaccaagcaaatattttgaagagtgctatgagaagctacctgcttatgaagatgtaaatctttctgaaataaagttagaaaaggtaaagcctgtaaatataaaggatacatattcttttacttcgcacattgctctgtatgagaattgtgcactacagtataaatttttcaaagaacttggatttacgcaggtaagagtaggtgcaacactctttggaacattagtgcatgagacaatagaagacattcatcgtgcagctatgcgtcatgaagaacagacaatagtgccggaaacaatacgagagtggtttgatacaaattatatgacattatcgaaaagtgagcattcttatttaggacaaccgcagatagaagctgcgtataaacaggttttgaggtatgttgagagaaatcagagtgactggagtcgaattcaagatgcagaggtggaagtaagtttagtaaagcctgattatatattgcttggaaaggttgaccttatcaggggcgaaggtgatacagtagagattgttgactttaaatccgagaagaaaccagatgttttaattgaaacagcggagatgaatcgttataggagacagcttgaagtgtatgctcatcttattgaggaaaagacaggtaaaaaggtaagtaaaatgcatttgtattatacaggtgaggataatggtgtaccaacagtaacatttaataagtcaacggaaatgattgataaaacaataaaagaatttgatgcagtggttgaaaaaatacaaagtaaagattttagtggtagagccaaagataaaaatctttgtgccaactgtgatatgagacattactgtagaagaaaaggagattgctaatggatggacagatttcatttacatttgaacaaagacaaccaataaaaggatatccggagttacactggacagggaaaaggccatatacatcgacacagtattatcctgcacagcttaaggaatcatatggagaacctaaggatggttggatgaataagatattttggggagataatcttcaggtgatgagccacatgttaaaggattatagaggaaagatagatctaatttatattgatccaccgtttgatagtaaggctgattataagaaaaaaattaagaaaaaaggagtagttgtctacaatgataatacatcattcgaagaaaaacagtatagtgatatttggacaaatgatgagtatttacaatttatgtatgagagattcgtgcttttaaaggaattattgtcagataccggtcaaattatagttcatttggattatcataaatgccatcatatacgattgattatggatgaggtttttggacaggataattttagaaacgaaataatatggacatataatggtggagccttaccaccgaaagattggccgagaaaacatgataatttattacggtatgtaaaatctaatacaggttggacatttaatactgagtatagaccatataatgaacagacagcattaagaatgagaagtatacataaaggagttatggtagatgtagatagaggaactccagttactgattggtggacagatataaaagtaccaacaggtccgatgaatcaagaaaaaaatggatatccgacacagaaacctgagaaactacttgaaagaataataagtacacttacaaatgagggggatttggtatttgattgttttatggggtcaggaacaacacaaacggtagctatgaaattaggacgtaagtttattggcgcagatattaatttaggtgcaattcaaactacaactaagcgtttgatttctgcaatgaaaaaacttgatgataaatgttattcaggatttgaagtttataatgtaaataattatgatttctttagaaatccagtagaagccaaagaattaattattgatgcattaggtatccaaaaatttgattcatcaacagtatatgacggcgaattagatggttggatggttaaaataatgcctacaaatcgtattgcaactaaggctgatttagaagaactcaaggctaatttaccataccatacatttgaaaagcgtaaggaagaaaatccgaatggcgtggtggaaaaaattaagattatttgcatgggacatgaggctgatttaaaggcatcgttggaacaggaactttcttcgtataatttggagatagagatagttgatatccttagggataagaaagatttacaatttaagagagaagcagatgccaatgttgttaaagaaaacgatcagattataataaaagaattttatccgatgaaccttttacagaaattaagcatgcagaaagaatcagttgaagattggaggcagttggtagaatctatctatattgactggaattatgatggacagacaatgaggccgacaatttgtgatattcctgcaaaagatgagttggtatctggtatatataaaattccagcttcagcaggtaaaattaaaataaagataacagatttgttatctgagtcacttgagctggaggtatagatatggcaaaagaagttggaatggaatttgccttttttgagttccttcgttcattctatgtagataatagaggaattataagaaataggtatcgtgaaataactaagaaatatctggattacaatgacaaggaaaagaacccagacgcatttttacgaaccccacagtttgaagccttagaaatgtatgtgtttgtaaaagaatttatgaataatcagcagatgtatcagatgtttgatgactggtcaaagagaaatggtgtgtttgcagatagacgattctatgatgaagctgggcagatgacattatatgatgtttattctccaaagcagtatcatgattattttttgcagataaagaaatatgcggaagattatccaaattatatttttgcattaactatgggactaggtaagacaattctcatggctacatgtattttttatgagtttcttcttgcatcaaaatggcctcgtgatgataggtattgtcataatgcattggtttttgcgccggacaaaacagtattacaatcgttaaaagaaatagtaatttttgataagagtaaggttgtacctcaggaatatattggtgtattagatacaaatattaaggtgcattttcttgaagatagtggaaccacattaaatacattagatggttccaagtataatataattatttctaatacacagaaaatcatattaaaggctcagcataaagaaaaaagttctgtagataagttgtttagtgatcagataccaggacaatccgttttggatgatgttcttggaatattacaggaaatcagtaacaacgatgatttgatgtcaaatcaacgttttgagaaacttaccaggctttcacaaatgggtatttatgtagatgaagcacatcatatgtttggagcagacttggagaaggctttgcacgaaaatggtaagggcactagcctgcgtaatactataaatgaattgtctaaggaattatctaagcatggaagtaaagtgattgcttgttataattttacaggaacaccatacgtcaataataagattcttccggaagttatatatgcttatggattgcaggcggcaattagaaataatttcttaaaagatactagtgttattggttatagtaacgtaaaaagcaaagaattcctaaaagctgttattgccgatttctgggcaaagtatggtggaaaagaatatgaaggattagcacctaaaatggctatttttggtgcagagatagcagaagttcgtgatgaaatcaggccagttgttgaagaagtactatctgaattgggaatacctcttgataaaattttagttaatgttggagacgaaaagattactaaatctgaagacataagagattttaacaatcttgatatagttggaacagcaggcagtaagaagcagtttatattgcttgttaataaaggtagagaggggtggaactgtagatcattatttagcgtggctctttttagaagtccaaagtcaaaagtttttgtgcttcaagcaacaatgagatgcttgagaaaaattacagatgaacaactaatggccacagtgtacttgtcaaaagagaatatggatatattggatgatgagcttaaaaagaattttagaactagcatagaggaacttgtagttaagaaggataaaaaacgtaagaaagttcctgtacgtgtgaaagaaccacctagaacattgcgcatgaacagattgcattataaatattctttggaaactaagcattatgatagtagattatcgtttggtttgaaagaaatagaaacagaaaattatgatgcgacaatgtatgttaaagaaggacttacaacttcgtctgttgtgtgtgaaagcaatgttaactatatggttagtaaattagcgtatactgagataacgttggtggcagaagtagcaaaatattttcctgatatcagatgcacagaagttgctaggatactgagggaatcagaagaaggtattgataaaatattagtagctgtcaatgaacataatgatattatttatgataaaattgtgccaaccatatttgaggcattataccgggttaacaaagagattgtaaaagaaaatgttgatgttaaattacttaagaagcctaaagaaggtggatattatgagtttagtggaaatgaggatttgattataatgcagaattcagaggattctgttgttgtgaaaaataaagacaagagttttcacgcagatacctatgtttttgattcgaagcctgagttacaattatttttacagttgcttgcaaatgagcacgtaaaaaaagcctatttcacgggaatgtttactgctgaccagactgatttttatgttccatatattgatccggaatcgaataggttaaggaagtattatccagatttcttagtaaaaatggatgatggaagttatttgattttggaagtaaaaggtgacaatatgatagacgatccggtagtaaaggcgaaaggagcagcggctgaggaggttgcagtagagagttcaatgaaatacgaaatgcttaaaggaacagacattatggaagggaaagcaaagatttagttaaaacgggtctcattcaacctgaattgcaaaagattttatgatggttggatgagccagattgtgaaaggaaactaagtgtatgaacaaagaatggttttcagattataaagagcagatttcattaaataatatgcaagaagcaagaaatgtgatattagataatattgataagactcaaatgatttatcggtatagcagaggtttgaatagggatttgcgaaatttggaaaatcatcaattatggttaagtagtgcatttaatttcaacgatccatatgattgtttagttacagttgattgcggattgaaagccagttatccgaagagccagagaaaagaagctatggaaacctatatgagacagaaaactgaaaataggaaaacagaagcattgagaagttcattatttgttgcttgtttttctgaagttaataattcatttcctatgtggggatattatgcggcagatcacaagggaatatgtttaggatataacctttatgagcttgttaagaaatacaaatgtatgccggtaatctatagcgataaattaatattttacagagaagatagttctgaaaaaaacatattggctaatacattaaccaagtcagatgagtggattcatgaaaaggaatggcggatagtaattaaagatgatattaatatgggaaaatcagggataataaaagattttgttttgccacgagaaatatatattggatgtagacagcaggaaacagtcgctgagaataacaataatcgtatgttacataataaaaaagagaatgagatgtatgctgatctagatgagatacttaaatgggcggagaataactatattgatgtatatatgccaataataactagaaaagaatataaaatgatggatagagcgttacgattgatttagcaagttttagcagaggtggctatatgtcagattttgaagaaaaatatgattatcaggaaattatggtagaagatatttcgcagatatatcaaattgcaaatgattataattcgttctatgatttaccaagatcaggtagaggtgacccaggtgatgaacgaacttacttacaggcattttatagaggacaaagcgattcttcttggaaaatcactccaagtatatgcagagatacatctgtggatgagagtatactggaatctggagatttactatttgaagtaatggcatataatcagcattatatacatgctacaagattaattgactttacaatggatataaatgtagcattgttttttgcttgttgtgaaaatattgaaaaagatgcggctatatttatatggtcatattctccgtatgatcctaaatggacaagaataaagatacagtgtgaacttgttaatgttaaaaagcaacgcataagtgtaagtgaatatgcagagatacttttgcagaaatatccgggattgaaagacaattgtacttataaaaaggatttctatactgatttagtttcttatttggatcatggttttatgattatgcaaccacgcaatccgtatttggaaaatatgagaatacaaagacaaaaagggtgtttatatgtttgtggtgtgaaatttgaaactccgattgataaaatgagaacaagtgttaatgcggggaataatatattgtgcccgcatgagccggaagcgcctaaagaattggacggaggtaattttttggtaaaggtggtcattcctgcaagattaaaaaatgtgataatgaaacaattggaagaaaagggaattacaaaagaagctttgttacccatgtgatgtaaataggcacttgtttaatgtagaaggatggtgagaactatggatataaagcagctaatcggcgaaaccacagattacgataaaaaggttgcacttgagataaagaaacccaaaagctggtgcaagagtataagtgcatttgcaaattgctatggtggtaagctggtatttggtgtggcaaatgatgatgcgttggttggtctttcggatgctgaaggagatgcagaaaaaattagtgagataattaaaacacaccttaatccaataccagagtttgagctttcatttgaaaaagataaagacaagacgtttgttattgtggaagttatgaaagggcagcagacaccatactattatgaaggcgatggacaacttattgcgtttatgcgtattggaaatgaaagtgttccagcaacaccttcacagttaagagagttggtacttcgtggaagtggtgaaagttatgatagtctgaagtcaagatatgattttagcaatatgtctttcacaaaattaaaatcggtatataagcaaagaacaggaaatgcatttgaagatacagattatgaatcttttggtttgattgatgagaaaggcaatctgacgaatgcaggagcacttctggcagatgaatctccggttcgtcattccagattattttgtacaagatggaatggacttacgaaggcatctggaattgtagatgcacttgatgataaggaatatacgggaagtcttgtcacactattacaggcaggaacagattttgtcagaaataattccaagaaagcatggcgtaaggtaggtgacggcagaattgaaatgcctgattatccggatcgtgcagtgcttgaaggggtagtaaatgcattgattcatagaaattatatagagataggcagcgaagttcatatagatatgtttgatgacagaattgaaatatattcaccgggtggaatggtaagtggaatatctttagagggaaaagatttattgaaaatcccatcaaagcgaagaaatccgatattagctgatatattcagccgtttgaaatacatggagcgtagaggcagtggatttaagaagatattggcagactatgagggtcaggttgaatttgatgagtccaagatgcctgtctttgatgcagataatgatgattttacattgactttgtataatttgaattatggacatgattatgtgatgaatgttaatgatactaggaatggcactcaaggtggcactcaaggtggcacccaagatggcactcaagacaaattgcagaaacaaatctttgatatgatagaagaaaatcctcaaatttccacatcagaaatcgcagcaaagttaggtgttggtgtaaggactgtgaagagaagaattaagcaaatgacgaatattgtatatgttggaagtgggtatagtgggcactgggagattaaaggggactaagcaggcatattttatggcaaagaatccaatgtgataatagttcagataagttatcacaaaattaaaaaaggagaatgataaatgaagagacaattgtcacaattgcagagattacttgtggcgggaatatatatttttataattgttatgatagatggattgctaaatgggggaatagcggatatattgaatcagtcggaggctgcatcagtttggtttttctctgggattttattgattataatgggaatgtatgtaactgaaccatatttttcgtcgccaacagacacattatctaatagtatttcgttgatattggttttactagctataacaaatcggcaggaattgaatggttacgttgaattacttgtttatgcagtttgtatgtttatattgagtatttttcatatgattgtaaaaaattataatgaaaaggcaaagaggattagtttttggtgtttaaagcatttaggaagttctaaaacgatgttttctgtggtgtatcttgtctcggcattttcgttttttagagataatacacctatgttattcgcagcgattgctttatggatatgtatggtaccaattggacttgtagaaagtattattgcccaatttagtcagttgatggggataataaaagaaaaagatattgattcgtgtattggagtagctataaaaaattcagagtcaaacttatatacaatttcagttcctaaaacagatgaaaaagaaaaacttgtatcttcaagtagaaactctgtgtatgctgtaaaggtagactctgattcttattgtttggggatagaaacacaaagaaagaaccttattgattcaatttggataagcataatgttattggataatgcagagctggaaattacactaagtgatttggaagatataggaattaacattaattatacggaaaatttaggagctgcacatgttttgaatgaaggaaaaataaaacaatcaattcttgaacagttgaaatcatcaactatttttatggaacgcgatgattttataggatttgttcttcctgaatcgaatgttagtactatcaggtttaatacgtgcaaaatagatgaaatgcgattaacagaaggaacaatagttaaaacacatattgcaggaagtgaagtcctttaccaagtaatcaatggcattacaaagatagctagtaacagtgcggatagcgagtatggatatatgtgtgcagtagcaagaaaattggggcattatgatgccgaacatcatgagataaaacatgttaattggacaccgaaagtttatgagcctgtatacctttgcaaagtaaatcgagatattgatttgcaagaaatagcaaaaacttctattggtcggttaccgggatctgatatgagtatacctataaagaatattaatgctcttgtaactcataatacagcagtattaggaatattgggagttggaaaatcttgtttaacgttcgagttgattaaaaaaattgttgctgctggaataaaagttatatgtttagatattacaaatcaatatgcaagtgataatggtttgtacaaatatattcctgaagcacaaatagtaagtgatttgctgcaggagaaaatagatgaacttgagtcacaatcaatgcgtacaggtacaagtgattcaaaatcttcgtggggaaatgttgagaattttaaaaagctgatggaatcggcagtgtctggatttatggatgctaacaacaaatctgtgatggtacttaatcctgaaaaatatattgttagacaagctgcaactgattttagaattacagagctgaaggatgtatctttggttgaaaaggttcaaattatttctgaaatagttcttaaaaagtgtatggatttgggacaaatagatagggcgagatgttgtgttgtttatgaagaagcgcattcattgactccagagtttaattcagttgtagtaaaagatgataactctcatgcgaatggcactgcaaaagttattttgcaaggtagaaagtacggacttggttgcattatagttacgcagcgtacggcaaatgtaaccaagagtatattgaaccaatgcaatacaatttttgcattaagagtatttgacgatacaggaaaatctttcttggaaaactatattggtagggattattcggatactttgccgacattggaagaaagacacgcaattgctattggaaaaggtatcgggctaaaacaaccagtgattttacagcttaatgatatgaagtatttacaaacgaatgacggagaggaaatagttgagaaaaacgaatgtgtggatgtagaaacagaagaaattacccccaatctataggatttttaatattacaaaaaattaaagtctcgttaaaagagtgatattgctttcaatgagatttaagatttggagagaatacataatatggcaaaaatgcgataaaatcggaatttatggctgattcgtatgagtacaatttcaaatcggtcttatttttgacactgtttgttgagactaacatgagactgaggaggttcaaaatcatggacataagtaaaaaagattggaagctatttcgagaaagattatcaggctggcaggaaaattatatggaaggtcttgttaaagagtatgcaaattttctgaatgatgataaaaagcctgcatcagagaaattctgggaacttgaaaaacggataaaagaagataaacgtcatccgggagttgtcatggaactgaaaaaatcagaggtaatatgggatatcgttcgtctcattagactgaaagtaactacatatgatgatttatcagactttagtgatgaattacagaatgaagtaaaaagaatacttgagatgagcaggtgatacatatggagattggtgcaacaaaagcagttcaagatagactaaaaacaacaaaaattgaagaaagcaaaggtgcttcacttgtgttctgctgggacacacatttgacgaaaataaaaggaagaaatgtcttgtttattgtgaatgccagtaatcgttatacaatagcaatgacagatattgaaccaagaaactggaattactatacaatgtttatccgcagtgtgattcatggcgtgatgcaggaaatgggatactccgaggatcagataggtcagtattttaaaatgtcagacgatacaactgtaacaaaaactcatggtaggaaatcggttggtggcattaacagaatggtaatggatgcacagtattttggtaagaagctggagaaagaagcaaagtatcaatgggaacttagtgagtatctgaacagagatatttgccagccagagggatttgatgcgtatggatatccgagtgaactttttaaattagacatggaacgattagggattgctgctaagagagagccagcaaaggtaattgattttgctcagtacatagaaaacaatcgtggtactaacgattagtaccacaaaatattttcttgctgaaatatcgcttggagattataatttcaataggtggacaagcaaaccgacagaatattattttgtgaatagtaaacaaacctgcaagccaccggaactacacacaataatgaaaaaatgcaatggtactggattggtactaaaaatatgtgaaacgaaaaataatgtgtggaaaaggcataggatatcaatacaaaacagtatagataaccatattgaaataacctaaatcaaactagattctgcgagtttgaataaataggtaaatccctacaaagcctgtttttatgggctttgtagggattttttgatggcgttgggtacgattgggtataaaattttattttgatatattgtgctatactaatgttgtaacaggagtggctgataagatataatgaactctgacgagttcatattcgaagttcctgcggaacttcgaatgcgcagaaaacagcgcagaaaagatgatataataaattcaacagaggaaagaggttatattatgccacaaagttacactcctgaatttaggaagaaaattgtacgccttcatacggaagaggatgtacctgcaaaagcatcactgctgagtatgggctatccaaagccagcatttccaagtggtgcagcgaattaagcaaagaatgtcaagctaaagctcacgaagatcctgatttaccaaatgaaatggaactcatgaaggagaatctccggttacgaaaagaactggaagaagcaaaaaagagaatctattcctaaaaaaacagcggcattctttgcaaaggaaatcgattagaggcttatcgattcacagaacaacatcatattgaatttggccggcgctggtttctcagaaggctggaaatctgtccaaatgcttactataactacctaaaacgcaggaaagctgattgttatacccgtaaatcagaagtacagaatcaaataaaagaagatctaccactcgcacaagggagtcgctggttaccgcagcatgaaagtttatctggaacgtaagtgtcatagtgtaccaatggtgttagagaaagggaaaatggaactttcggagaaatggaaatggactagcggagattattctgagggagagtctttgctggtagaggtgtaggatgaaagaaatctatgaatacaaaaaagcaacgatagaagatatcaatgaactggtaagaacaagaatcattgtccttcgtgctgccaataaactgtcggatgatgtggatatgtcattggtggaaaaagaatcctatgagtattataagcgaacattagaaaatggtgagcatattgcatatcttgtgtatgataacgaaacttttattggtgccggcggtgtcagcttttatcaggttatgccaacatatcataatccaactggtaaaaaggcgtacattatgaatatgtatacggcatcagaatatcggagacaggggattgcatttcatacattagatttacttgtaaaggatgtaaggaaacagggcgtatcacagattgctttagaggcgacagagatgggacgaccgttatatgaaaagtatggatttgtaaaaatggaagatgaaatggagctgaagctgaagcatagctatgtgtgttccaattagaaagtaggtatataatgataaacagctctttaacagcggaatgtaataagatatttaatttttggaaattagaagaatattttacaccatcagattatccggcattggttttaacaataaaagagggaaaacagaatattccgtttgatgcgtattacaatgatcacagtatcagaagtttgccattaaaaagatacaaggctcataatgagtatttgagacagaagaacaaatctgatgagagtttatataatcgagcaaatatttattgtggctgttatagaactaaagattttgttgaaaaaatggctgaaaaatgcaaattggatagggaaaaatatgcggagataaatgaattgacaggacggttttatgctttttctgttcagatagatttagatgggaaaattacagaagagggtttgcaagtcagcccgttcttttacgctgtactttgcatgataaaagccgagggcataaatgttaatattatgcaagaaaatatatggaagctagatgaagaagtaaatgaaatacttaaacaaaataatgtacgaatattggagtttgaagatgtaacaatagtaaaaaatattatatttgataaactgagaattaagtctgaaaatgaaattgggctaaaaagtgcttcggataaagtatatgcgtgcaaaggtttgaaaaaagaagatgaaacaagtgactttaccagtttttatttggacgaaatagaaaatgttcagaaaaactatgagaataatgagaatttgataaaatataccacttcattattggaagaaaaacaaaaaaggataatgatagatagcgatgtttgttccatgaaaaaatggttggaagtagatagatttccaatgggaaaatatccatcaaagttttctccgacattaatgcagcaaatagctataaacatagctatatcagaaaaggatagaaaagaaaaaatattttcagtaaatggaccaccaggaacgggaaaaacaactcttttgaaagaaataatagcttcaaatgttgtccaactagcagaagttttaattaaaaaaggaataggtggtagtaattttgttcctaggaaagttgaatctgcatcaaatgctagttatacagaaaaatattatgaaataccagaagaaatttctaaatatggaattcttgtggtatcaaataataatggagctgtagaaaatgtcacactcgatttaccgaaatcttgcgatatgggaaaggataaaactaggacagattactttgacagagaaataaataaagaagtgtatttttcagcggtagcagataatcttttaggtaaagagggcggtgcatggggattaatatcagctcgtatgggtagaaaatcctatgttacagaagttttagaatcttgtgtattcgctaaaaaaaatgatgcttcggataaagtaacattagatcttgcaagagaagatagtatttcgtgggaggaagctgttgataagtttaatgtagctaaaggaaaggttttgttattaagagaaggcataaaaaaggaccaaaaactcttggatgatttttataaagaaggagagagttttgcgaagagtaaattggatttaaaacagttgctcatagaaaaggagcagttaaatgtaaagttaaatgaggtaagaacggaattagaaagtaatgaacagttgactttagagcaggaagaggaaattaagtatattaaggaacatagctctatttttaagaaactacttatcctttttggaatagggaaaataggcaggcatattgctgaaaaacaaaaatatattgatgggttaataattaagcacgaagatattaaacatagatatagtttggctgtgaaaaatacagaagaagtatgtacaaaaattgaaaagcaatatagtataatctctactttagaaaagcaggtacagatacttgaagaaaaaatatatggagataaggagtctttaaaaaacaaatacaaaaataattttgcggataggaatttctataaaaatattaaggaatctgaggattcgcagaatgcgtgtccatggacatttgaggaatatgatatggcgagggaggcattgttttatgcttcattacaagtgcgaaaagcgtttattttagaatcgccatatataaaaagaaatctgtttgtatatgaagcatataacaatggaaaatacacaatagcagaaaaacaacagatgtttccacatttgtttaattcattgtcagtagtgatacctgtgttgtcttctacttttgcttcggtgggaagatttttaaaacatgctgggaatatgagtttaggtatgcttatcattgacgaatccggacaggcagttccacagtctgctttaggagcaatttatagaacaaggcgggctgttgttgtgggagatccgttgcaagtagaacctgttgtaacaattcctaaagtgttaattgatatactagctgatagtacttgcgtagcaaatgcatataaggtgatcgaaaattcagttcagactttttctgataatataaatgagtttaatggtatgatcggggaacgccaggttggttgcccgttggttgttcacagaaggtgcatagaaccaatgttttctatttcaaatttgatttcatatgacaatagaatgtttaataaaacaaataagaaggaagaatatttgaaaccggaaaatctatttttgataaaaaaatctggatggattaatgtggaaggggaagaaaatggtggtaaggatcattttgtgaaaaatcaagcagagagagtatgccaattaatggaagatgcagtacatatatattcagatttgtttgagacagatgataagatttttataattacaccttttagaacagttgcagaatcaatgcgtaagtttatcattagctacttttcagtaaaaggatatgataagcaaattttgtcaaagtggacgaaaaattgtgttggtacagtacatacttttcaagggaaagatgcgaatgaggtacttttggtattaggttgttcaaataaaagtgcaggtgcaatgaattgggtggtaaagaaagctaatatacttaatgttgcatgcaccagagcaaaatatagaatagcatttattggtaatataaatgattggaaaaatagaaggtacttcagagagtttattccgagtttcattgatataataaatgtgtaaaaaatagacgatatggagtgggagtaggagatattgctatggctgtgtcatataacaaattatgaaaattattagtggataaaaaaatgagcaaatctgatttgcgtaaaaggcagaaattgcgcctgacacgatgaaaaaaatacgtcgtgatgaagcttataaaaaaatcgcaaggcaatggtgtgaaaggcataagattgatattgttgaataaaagaaaagagctgctatgatacccacagaagatattatgccgatagtgaaaaaaacgattgctgcatcaattaaatgtaacacccatcggggatacattggttggagcagctgtgataatatttgtatggatatgcatgcatgccttgatatgtgtgctgagaccttagaaatgcgtggctatatggctgcacttgaggcggctgcatacattttggtatctagcgttaagttagcatctcatgcggatagtagttcgggaatgcttacagatgttatcatgtgtacatacgaactgatagacaaatgcacaaaagaaatcgaaaaagaagacaaacaaatgcgggatcaagcacttgcattaattataaaagaggcaaaaaagagtgtgtttgatggttggactgactggcgctataacctgctgaaaagtgggatttgcctgtgtgatgaaaagagtgcaaagaaacttgaaaaagttttggatactttgttggaaatttcgcgggaggattattttccagaatacacgaaaaaagaagatttgattgtaagatatcttttacatagacatttatatggcaaagagaatacgcagaaggagttatatcagaatattctgataaattaactctgtattatagcgattaaggatgctatggaagagaagaattatgatgaagcagagaagctttgtttagagaaggcaaatgcagaaaatacatggcattatcgtagtggtgatccggaagattggaataatgtgctatatgacatatataagacagcaaacaacagggaaaagcaaatcgcacaggcaaaaaagctgttattaatgggaaatgagaagttctggggtgttttgaaacagatttacagagagtgtggtgcatggaatgagaattacaagagtctattggatgaattaaaggatagcaagcgaactgtttgctaccgcagtgttcttatttcagaaaatgaaaagaagagattacttgaagatgtaatggagaatccgtatgatttgttttattatggaaaatatttggtgaaggaatatccagagcagatatatgagttgtgttataaggaaataagtgaaagctgtgctcaggcaaaggatagacgagaatataagaagataacgaagaatatggcacagcttataaaatggaagggtaatgataccgctaagtctttaattgaggaattgaagcagagatatccaagaaaaccggcattgttggatgaattggagaaggtggagaagaaattgtaattcaaataaaatcaatttggtaaggatagaccattgccctgtcatttgccgtcatctttcgactctcccatgcagggtatgtcttgccctcaagacataccctgcatttgtgttttaaaagctatcatgctaaaatgggatacatagtgacaggcaaaaggaggttttaccatgtattatgtaccggatggcacaaagcagtgcggatattatgaatgtaaaaagtgcgggaatcggtttctgtccttgcagacgatgacgcggattccctgtccggattgtgcatcggaggttgattatgagatcgggccggatgaaacgcttgcggacgtgacagatacggcagtgcttctgcagaaaatcgagggcgaggaggaagtggcgaaaatggatgcgctcttaagtcttgcgattaccggcggagactttaactggatttaagaaaagatagaacgggaagtggatgaaacagataagacacagaacaggagcggtgacagagatggaacagacaacggcaaaaaagaataaatatgagattgatatgtgcaatggaacgattatggacaaattgatttccttctcgctgccgctcatgctgtcgggcattttacagctgatgttcaatgcggtagatattatcgtggtgggcaggttttccggcagccaggcgctggcagcggtgggatcgaccagtgcgctcatcaacgtgttcacgaatctgtttatcggaatttcgctgggggcaaatgtactgacggcgcgtttctatgcggcggggcgtgagaaagaggtgtctgagaccgtacataccgcgataaccctggcactggtcagtggaattatcatggcgctggtgggacttgttttttccaagggagcgctggcgctgatggggacaccggacgacgtcatcggactgtcggcactttatatgcggatttattttctgggaatgccgtttttcatgctctacaattatggcgcggcgattctgcgcgccgtcggggacacaaaacgtccgctgctgtttttgatgattgcgggagttatcaacgc

SEQ ID NO: 5 - DNA, 1398 bp, Roseburia intestinalis
  modified_base (998)..(998): a, c, t, g, unknown or other
gctccctccttgcggttgggtcactgacttcgggcattaccaactcccatggtgtgacgggcggtgtgtacaagacccgggaacgtattcaccgcgacattctgattcgcgattactagcgattccagcttcgtgcagtcgagttgcagactgcagtccgaactgagacgttatttttgagatttgctccccctcgcaggctcgcttccctttgtttacgccattgtagcacgtgtgtagcccaagtcataaggggcatgatgatttgacgtcatccccaccttcctccaggttatccctggcagtctccctagagtgcccggcttacccgctggctactaagaataggggttgcgctcgttgcgggacttaacccaacatctcacgacacgagctgacgacaaccatgcaccacctgtcaccgatgctccgaagagaaaacacattacatgttctgtcatcgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagtaatcgtccagtaagccgccttcgccactggtgttcctcctaatatctacgcatttcaccgctacactaggaattccacttacccctccgacactctagtccgacagtttccaatgcagtaccggggttgagccccgggctttcacatcagacttgccgtaccgcctgcgctccctttacacccagtaaatccggataacgcttgcaccatacgtattaccgcggctgctggcacgtatttagccggtgcttcttagtcaggtaccgtcatttcttcttccctgnctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtaggccgttaccccaccaactggctaatcagacgcgggtccatctcataccaccggagtttttcacaccaggtcatgcgaccctgtgcgcttatgcggtattagcagtcgtttccaactgttatccccctgtatgaggcaggttacccacgcgttactcacccgtccgccactcagtcacaaaatcttcattccgaagaaatcaaataaagtgcttcgttcgactgca

SEQ ID NO: 6 - DNA, 1400 bp, Roseburia faecis
agctccctccttgcggttgggtcactgacttcggacatttccaactcccatggtgtgacgggcggtgtgtacaagacccgggaacgtattcaccgcagcattctgatctgcgattactagcgattccagcttcgtgtagtcgggttgcagactacagtccgaactgagacgttatttttgagatttgctcggcctcacggctttgcttccctttgtttacgccattgtagcacgtgtgtagcccaagtcataaggggcatgatgatttgacgtcatccccgccttcctccaggttatccctggcagtctccctagagtgcccggccgaaccgctggctactaaggacaggggttgcgctcgttgcgggacttaacccaacatctcacgacacgagctgacgacaaccatgcaccacctgtcaccgatgctccgaagagaaagtacattacatactctgtcatcgggatgtcaagacttggtaaggttcttcgcgttgcttcgaattaaaccacatgctccaccgcttgtgcgggtccccgtcaattcctttgagtttcattcttgcgaacgtactccccaggtggaatacttattgcgtttgctgcggcaccgaagagcaatgctccccgacacctagtattcatcgtttacggcgtggactaccagggtatctaatcctgtttgctccccacgctttcgagcctcagcgtcagttatcgtccagtaagccgccttcgccactggtgttcctcctaatatctacgcatttcaccgctacactaggaattccacttacccctccgacactctagtacgacagtttccaatgcagtaccggggttgagccccgggctttcacatcagacttgccgcaccgcctgcgctccctttacacccagtaaatccggataacgcttgcaccatacgtattaccgcggctgctggcacgtatttagccggtgcttcttagtcaggtaccgtcattcttcttccctgctgatagagctttacataccgaaatacttcttcgctcacgcggcgtcgctgcatcagggtttcccccattgtgcaatattccccactgctgcctcccgtaggagtttgggccgtgtctcagtcccaatgtggccggtcaccctctcaggtcggctactgatcgtcgctttggtaggccgttaccctgccaactggctaatcagacgcgggtccatctcataccaccggagtttttcacaccggatcatgcgatcctgtgcgcttatgcggtattagcagtcgtttccaactgttatccccctgtatgaggcaggttacccacgcgttactcacccgtccgccactcagtcacaaaatcttcatttccgaagaaaatcaaatagagtgcttcgtccgactgcag

SEQ ID NO: 7 - DNA, 15 bp, Artificial Sequence
  Description of Artificial Sequence: Synthetic oligonucleotide
gtggtggtggtggtg
